United States Patent 12,767,733 (DIMERIC FUSION PROTEINS) - sequence listing, part 2

SEQ ID NO: 2202 - protein, 654 aa, synthetic construct
  REGION 1..654: note = CDH3 (P22223) SP+PP+ECD
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGG

SEQ ID NO: 2203 - protein, 734 aa, synthetic construct
  REGION 1..734: note = CDH4 (P55283) SP+PP+ECD
MTAGAGVLLLLLSLSGALRAHNEDLTTRETCKAGFSEDDYTALISQNILEGEKLLQVKFSSCVGTKGTQYETNSMDFKVGADGTVFATRELQVPSEQVAFTVTAWDSQTAEKWDAVVRLLVAQTSSPHSGHKPQKGKKVVALDPSPPPKDTLLPWPQHQNANGLRRRKRDWVIPPINVPENSRGPFPQQLVRIRSDKDNDIPIRYSITGVGADQPPMEVFSIDSMSGRMYVTRPMDREEHASYHLRAHAVDMNGNKVENPIDLYIYVIDMNDNRPEFINQVYNGSVDEGSKPGTYVMTVTANDADDSTTANGMVRYRIVTQTPQSPSQNMFTINSETGDIVTVAAGLDREKVQQYTVIVQATDMEGNLNYGLSNTATAIITVTDVNDNPPEFTASTFAGEVPENRVETVVANLTVMDRDQPHSPNWNAVYRIISGDPSGHFSVRTDPVTNEGMVTVVKAVDYELNRAFMLTVMVSNQAPLASGIQMSFQSTAGVTISIMDINEAPYFPSNHKLIRLEEGVPPGTVLTTFSAVDPDRFMQQAVRYSKLSDPASWLHINATNGQITTAAVLDRESLYTKNNVYEATFLAADNGIPPASGTGTLQIYLIDINDNAPELLPKEAQICEKPNLNAINITAADADVDPNIGPYVFELPFVPAAVRKNWTITRLNGDYAQLSLRILYLEAGMYDVPIIVTDSGNPPLSNTSIIKVKVCPCDDNGDCTTIGAVAAAGLGTGA

SEQ ID NO: 2204 - protein, 599 aa, synthetic construct
  REGION 1..599: note = CDH5 (P33151) SP+PP+ECD
MQRLMMLLATSGACLGLLAVAAVAAAGANPAQRDTHSLLPTHRRQKRDWIWNQMHIDEEKNTSLPHHVGKIKSSVSRKNAKYLLKGEYVGKVFRVDAETGDVFAIERLDRENISEYHLTAVIVDKDTGENLETPSSFTIKVHDVNDNWPVFTHRLFNASVPESSAVGTSVISVTAVDADDPTVGDHASVMYQILKGKEYFAIDNSGRIITITKSLDREKQARYEIVVEARDAQGLRGDSGTATVLVTLQDINDNFPFFTQTKYTFVVPEDTRVGTSVGSLFVEDPDEPQNRMTKYSILRGDYQDAFTIETNPAHNEGIIKPMKPLDYEYIQQYSFIVEATDPTIDLRYMSPPAGNRAQVIINITDVDEPPIFQQPFYHFQLKENQKKPLIGTVLAMDPDAARHSIGYSIRRTSDKGQFFRVTKKGDIYNEKELDREVYPWYNLTVEAKELDSTGTPTGKESIVQVHIEVLDENDNAPEFAKPYQPKVCENAVHGQLVLQISAIDKDITPRNVKFKFILNTENNFTLTDNHDNTANITVKYGQFDREHTKVHFLPVVISDNGMPSRTGTSTLTVAVCKCNEQGEFTFCEDMAAQVGVSIQ

SEQ ID NO: 2205 - protein, 615 aa, synthetic construct
  REGION 1..615: note = CDH6 (P55285) SP+PP+ECD
MRTYRYFLLLFWVGQPYPTLSTPLSKRTSGFPAKKRALELSGNSKNELNRSKRSWMWNQFFLLEEYTGSDYQYVGKLHSDQDRGDGSLKYILSGDGAGDLFIINENTGDIQATKRLDREEKPVYILRAQAINRRTGRPVEPESEFIIKIHDINDNEPIFTKEVYTATVPEMSDVGTFVVQVTATDADDPTYGNSAKVVYSILQGQPYFSVESETGIIKTALLNMDRENREQYQVVIQAKDMGGQMGGLSGTTTVNITLTDVNDNPPRFPQSTYQFKTPESSPPGTPIGRIKASDADVGENAEIEYSITDGEGLDMFDVITDQETQEGIITVKKLLDFEKKKVYTLKVEASNPYVEPRFLYLGPFKDSATVRIVVEDVDEPPVFSKLAYILQIREDAQINTTIGSVTAQDPDAARNPVKYSVDRHTDMDRIFNIDSGNGSIFTSKLLDRETLLWHNITVIATEINNPKQSSRVPLYIKVLDVNDNAPEFAEFYETFVCEKAKADQLIQTLHAVDKDDPYSGHQFSFSLAPEAASGSNFTIQDNKDNTAGILTRKNGYNRHEMSTYLLPVVISDNDYPVQSSTGTVTVRVCACDHHGNMQSCHAEALIHPTGLSTGA

SEQ ID NO: 2206 - protein, 607 aa, synthetic construct
  REGION 1..607: note = CDH7 (Q9ULB5) SP+PP+ECD
MKLGKVEFCHFLQLIALFLCFSGMSQAELSRSRSKPYFQSGRSRTKRSWVWNQFFVLEEYMGSDPLYVGKLHSDVDKGDGSIKYILSGEGASSIFIIDENTGDIHATKRLDREEQAYYTLRAQALDRLTNKPVEPESEFVIKIQDINDNEPKFLDGPYTAGVPEMSPVGTSVVQVTATDADDPTYGNSARVVYSILQGQPYFSVEPKTGVIKTALPNMDREAKDQYLLVIQAKDMVGQNGGLSGTTSVTVTLTDVNDNPPRFPRRSYQYNVPESLPVASVVARIKAADADIGANAEMEYKIVDGDGLGIFKISVDKETQEGIITIQKELDFEAKTSYTLRIEAANKDADPRFLSLGPFSDTTTVKIIVEDVDEPPVFSSPLYPMEVSEATQVGNIIGTVAAHDPDSSNSPVRYSIDRNTDLERYFNIDANSGVITTAKSLDRETNAIHNITVLAMESQNPSQVGRGYVAITILDINDNAPEFAMDYETTVCENAQPGQVIQKISAVDKDEPSNGHQFYFSLTTDATNNHNFSLKDNKDNTASILTRRNGFRRQEQSVYYLPIFIVDSGSPSLSSTNTLTIRVCDCDADGVAQTCNAEAYVLPAGLST

SEQ ID NO: 2207 - protein, 621 aa, synthetic construct
  REGION 1..621: note = CDH8 (P55286) SP+PP+ECD
MPERLAEMLLDLWTPLIILWITLPPCIYMAPMNQSQVLMSGSPLELNSLGEEQRILNRSKRGWVWNQMFVLEEFSGPEPILVGRLHTDLDPGSKKIKYILSGDGAGTIFQINDVTGDIHAIKRLDREEKAEYTLTAQAVDWETSKPLEPPSEFIIKVQDINDNAPEFLNGPYHATVPEMSILGTSVTNVTATDADDPVYGNSAKLVYSILEGQPYFSIEPETAIIKTALPNMDREAKEEYLVVIQAKDMGGHSGGLSGTTTLTVTLTDVNDNPPKFAQSLYHFSVPEDVVLGTAIGRVKANDQDIGENAQSSYDIIDGDGTALFEITSDAQAQDGIIRLRKPLDFETKKSYTLKVEAANVHIDPRFSGRGPFKDTATVKIVVEDADEPPVFSSPTYLLEVHENAALNSVIGQVTARDPDITSSPIRFSIDRHTDLERQFNINADDGKITLATPLDRELSVWHNITIIATEIRNHSQISRVPVAIKVLDVNDNAPEFASEYEAFLCENGKPGQVIQTVSAMDKDDPKNGHYFLYSLLPEMVNNPNFTIKKNEDNSLSILAKHNGFNRQKQEVYLLPIIISDSGNPPLSSTSTLTIRVCGCSNDGVVQSCNVEAYVLPIGLSM

SEQ ID NO: 2208 - protein, 615 aa, synthetic construct
  REGION 1..615: note = CDH9 (Q9ULB4) SP+PP+ECD
MRTYHYIPLFIWTYMFHTVDTILLQEKPNSYLSSKKIAGLTKDDGKMLRRTKRGWMWNQFFLLEEYTGTDTQYVGKLHTDQDKGDGNLKYILTGDGAGSLFVIDENTGDIHAAKKLDREEKSLYILRAKAIDRKTGRQVEPESEFIIKIHDINDNEPKFTKDLYTASVPEMSGVGTSVIQVTATDADDANYGNSAKVVYSILQGQPYFSVDPESGIIKTALPDMSRENREQYQVVIQAKDMGGQMGGLSGTTTVNITLTDVNNNPPRFPQSTYQFNSPESVPLGTHLGRIKANDPDVGENAEMEYSIAEGDGADMFDVITDKDTQEGIITVKQNLDFENQMLYTLRVDASNTHPDPRFLHLGPFKDTAVVKISVEDIDEPPVFTKVSYLIEVDEDVKEGSIIGQVTAYDPDARNNLIKYSVDRHTDMDRIFGIHSENGSIFTLKALDRESSPWHNITVTATEINNPKQSSHIPVFIRILDINDHAPEFAMYYETFVCENAKPGQLIQTVSVMDKDDPPRGHKFFFEPVPEFTLNPNFTIVDNKDNTAGIMTRKDGYSRNKMSTYLLPILIFDNDYPIQSSTGTLTIRVCACDNQGNMQSCTAEALILSAGLSTGA

SEQ ID NO: 2209 - protein, 700 aa, synthetic construct
  REGION 1..700: note = CDHR1 (Q96JP9) SP+PP+ECD
MRRCRWAALALGLLRLCLAQANFAPHFFDNGVGSTNGNMALFSLPEDTPVGSHVYTLNGTDPEGDPISYHISFDPSTRSVFSVDPTFGNITLVEELDREREDEIEAIISISDGLNLVAEKVVILVTDANDEAPRFIQEPYVALVPEDIPAGSIIFKVHAVDRDTGSGGSVTYFLQNLHSPFAVDRHSGVLRLQAGATLDYERSRTHYITVVAKDGGGRLHGADVVFSATTTVTVNVEDVQDMAPVFVGTPYYGYVYEDTLPGSEVLKVVAMDGDRGKPNRILYSLVNGNDGAFEINETSGAISITQSPAQLQREVYELHVQVTEMSPAGSPAAQATVPVTIRIVDLNNHPPTFYGESGPQNRFELSMNEHPPQGEILRGLKITVNDSDQGANAKFNLQLVGPRGIFRVVPQTVLNEAQVTIIVENSAAIDFEKSKVLTFKLLAVEVNTPEKFSSTADVVIQLLDTNDNVPKFDSLYYVARIPENAPGGSSVVAVTAVDPDTGPWGEVKYSTYGTGADLFLIHPSTGLIYTQPWASLDAEATARYNFYVKAEDMEGKYSVAEVFITLLDVNDHPPQFGKSVQKKTMVLGTPVKIEAIDEDAEEPNNLVDYSITHAEPANVFDINSHTGEIWLKNSIRSLDALHNITPGRDCLWSLEVQAKDRGSPSFSTTALLKIDITDAETLSRSPMAAFLIQTKDNPMK

SEQ ID NO: 2210 - protein, 1154 aa, synthetic construct
  REGION 1..1154: note = CDHR2 (Q9BYE9) SP+PP+ECD
MAQLWLSCFLLPALVVSVAANVAPKFLANMTSVILPEDLPVGAQAFWLVAEDQDNDPLTYGMSGPNAYFFAVTPKTGEVKLASALDYETLYTFKVTISVSDPYIQVQREMLVIVEDRNDNAPVFQNTAFSTSINETLPVGSVVFSVLAVDKDMGSAGMVVYSIEKVIPSTGDSEHLFRILANGSIVLNGSLSYNNKSAFYQLELKACDLGGMYHNTFTIQCSLPVFLSISVVDQPDLDPQFVREFYSASVAEDAAKGTSVLTVEAVDGDKGINDPVIYSISYSTRPGWFDIGADGVIRVNGSLDREQLLEADEEVQLQVTATETHLNIYGQEAKVSIWVTVRVMDVNDHKPEFYNCSLPACTFTPEEAQVNFTGYVDEHASPRIPIDDLTMVVYDPDKGSNGTFLLSLGGPDAEAFSVSPERAVGSASVQVLVRVSALVDYERQTAMAVQVVATDSVSQNFSVAMVTIHLRDINDHRPTFPQSLYVLTVPEHSATGSVVTDSIHATDPDTGAWGQITYSLLPGNGADLFQVDPVSGTVTVRNGELLDRESQAVYYLTLQATDGGNLSSSTTLQIHLLDINDNAPVVSGSYNIFVQEEEGNVSVTIQAHDNDEPGTNNSRLLFNLLPGPYSHNFSLDPDTGLLRNLGPLDREAIDPALEGRIVLTVLVSDCGEPVLGTKVNVTITVEDINDNLPIFNQSSYNFTVKEEDPGVLVGVVKAWDADQTEANNRISFSLSGSGANYFMIRGLVLGAGWAEGYLRLPPDVSLDYETQPVFNLTVSAENPDPQGGETIVDVCVNVKDVNDNPPTLDVASLRGIRVAENGSQHGQVAVVVASDVDTSAQLEIQLVNILCTKAGVDVGSLCWGWFSVAANGSVYINQSKAIDYEACDLVTLVVRACDLATDPGFQAYSNNGSLLITIEDVNDNAPYFLPENKTFVIIPELVLPNREVASVRARDDDSGNNGVILFSILRVDFISKDGATIPFQGVFSIFTSSEADVFAGSIQPVTSLDSTLQGTYQVTVQARDRPSLGPFLEATTTLNLFTVDQSYRSRLQFSTPKEEVGANRQAINAALTQATRTTVYIVDIQDIDSAARARPHSYLDAYFVFPNGSALTLDELSVMIRNDQDSLTQLLQLGLVVLGSQESQESDLSKQLIS

SEQ ID NO: 2211 - protein, 713 aa, synthetic construct
  REGION 1..713: note = CDHR3 (Q6ZTQ4) SP+PP+ECD
MQEAIILLALLGAMSGGEALHLILLPATGNVAENSPPGTSVHKFSVKLSASLSPVIPGFPQIVNSNPLTEAFRVNWLSGTYFEVVTTGMEQLDFETGPNIFDLQIYVKDEVGVTDLQVLTVQVTDVNEPPQFQGNLAEGLHLYIVERANPGFIYQVEAFDPEDTSRNIPLSYFLISPPKSFRMSANGTLFSTTELDFEAGHRSFHLIVEVRDSGGLKASTELQVNIVNLNDEVPRFTSPTRVYTVLEELSPGTIVANITAEDPDDEGFPSHLLYSITTVSKYFMINQLTGTIQVAQRIDRDAGELRQNPTISLEVLVKDRPYGGQENRIQITFIVEDVNDNPATCQKFTFSIMVPERTAKGTLLLDLNKFCFDDDSEAPNNRFNFTMPSGVGSGSRFLQDPAGSGKIVLIGDLDYENPSNLAAGNKYTVIIQVQDVAPPYYKNNVYVYILTSPENEFPLIFDRPSYVFDVSERRPARTRVGQVRATDKDLPQSSLLYSISTGGASLQYPNVFWINPKTGELQLVTKVDCETTPIYILRIQATNNEDTSSVTVTVNILEENDEKPICTPNSYFLALPVDLKVGTNIQNFKLTCTDLDSSPRSFRYSIGPGNVNNHFTFSPNAGSNVTRLLLTSRFDYAGGFDKIWDYKLLVYVTDDNLMSDRKKAEALVETGTVTLSIKVIPHPTTIITTTPRPRVTYQVLRKNVYSPSAWYVP

SEQ ID NO: 2212 - protein, 686 aa, synthetic construct
  REGION 1..686: note = CDHR4 (A6H8M9) SP+PP+ECD
MVLLRLLVFLFAPVVSDLCSLPCFINVSESQGPGTVLQFLSFNCSSYTPTPTLELLNVQPPTTFFNPPSLARWQGTYVGKLTLSSSAQLDALMVNHYKVQLKFTCGNHVMEGSLSVDVQRDLSHIQCAGQFASPAGEMIQVPETVTPGARLYTLLLPGLELHGAQMSIISAQDLPHFPGPFSINEQGWLQAPSQGLLGQAQKVFQLQISVSFGQRQSCQGMVIVKVLPVPSSQVSFLEQAQNITIPENLAPGSEVVQVQARGVDLRYEILSPVPSPLFSIGRADGVVRTTTPLELARTSGTAVSRLQVKAFEQGQLWASAKLNLTMNVQLVNLWPPRCLPALLVSQIPETAPVGTVLNTLTCEDPDSVGATLDYKLWFRSSSNPASLCLYDRVLEVNATLDCDTPGACFQHAASILVLDGGQPQMTTEVPVLVMVTPINEFSPACAPRTFRVQEDAAPHTLLGSVVGTDMDYPHDNIEYYTSGGPTTFAVDRLSGEVHLLGPLDYEQQRLYRLTVLVIDHGQDQNPNHHLSGSCTITIEVEDVNDHAPECEPPFQELTIYAPLGRSVEVTKMSCQIPQEPQRLIYSYSIVGGNSQNRFILQGAILVHSDLVLGPFWPEQPRTYELLICVADAGPSTPHLSTTATIIVHLVPRRASTVATSTHRTTVPSTMTPMLVTDTEAFWQPQP

SEQ ID NO: 2213 - protein, 669 aa, synthetic construct
  REGION 1..669: note = CDHR5 (Q9HBB8) SP+PP+ECD
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQRLYRGTVARGAGAGVVVKDAAAPSQPLRIQAQDPEFSDLNSAITYRITNHSHFRMEGEVVLTTTTLAQAGAFYAEVEAHNTVTSGTATTVIEIQVSEQEPPSTDVPPSPEAGGTTGPWTSTTSEVPRPPEPSQGPSTTSSGGGTGPHPPSGTTLRPPTSSTPGGPPGAENSTSHQPATPGGDTAQTPKPGTSQPMPPGVGTSTSHQPATPSGGTAQTPEPGTSQPMPPSMGTSTSHQPATPGGGTAQTPEAGTSQPMPPGMGTSTSHQPTTPGGGTAQTPEPGTSQPMPLSKSTPSSGGGPSEDKRFSVVDMA

SEQ ID NO: 2214 - protein, 963 aa, synthetic construct
  REGION 1..963: note = CDON (Q4KMG0) SP+PP+ECD
MHPDLGPLCTLLYVTLTILCSSVSSDLAPYFTSEPLSAVQKLGGPVVLHCSAQPVTTRISWLHNGKTLDGNLEHVKIHQGTLTILSLNSSLLGYYQCLANNSIGAIVSGPATVSVAVLGDFGSSTKHVITAEEKSAGFIGCRVPESNPKAEVRYKIRGKWLEHSTENYLILPSGNLQILNVSLEDKGSYKCAAYNPVTHQLKVEPIGRKLLVSRPSSDDVHILHPTHSQALAVLSRSPVTLECVVSGVPAPQVYWLKDGQDIAPGSNWRRLYSHLATDSVDPADSGNYSCMAGNKSGDVKYVTYMVNVLEHASISKGLQDQIVSLGATVHFTCDVHGNPAPNCTWFHNAQPIHPSARHLTAGNGLKISGVTVEDVGMYQCVADNGIGFMHSTGRLEIENDGGFKPVIITAPVSAKVADGDFVTLSCNASGLPVPVIRWYDSHGLITSHPSQVLRSKSRKSQLSRPEGLNLEPVYFVLSQAGASSLHIQAVTQEHAGKYICEAANEHGTTQAEASLMVVPFETNTKAETVTLPDAAQNDDRSKRDGSETGLLSSFPVKVHPSAVESAPEKNASGISVPDAPIILSPPQTHTPDTYNLVWRAGKDGGLPINAYFVKYRKLDDGVGMLGSWHTVRVPGSENELHLAELEPSSLYEVLMVARSAAGEGQPAMLTFRTSKEKTASSKNTQASSPPVGIPKYPVVSEAANNNFGVVLTDSSRHSGVPEAPDRPTISTASETSVYVTWIPRANGGSPITAFKVEYKRMRTSNWLVAAEDIPPSKLSVEVRSLEPGSTYKFRVIAINHYGESFRSSASRPYQVVGFPNRFSSRPITGPHIAYTEAVSDTQIMLKWTYIPSSNNNTPIQGFYIYYRPTDSDNDSDYKRDVVEGSKQWHMIGHLQPETSYDIKMQCFNEGGESEFSNVMICETKVKRVPGASEYPVKDLSTPPNSLGSGGNVGPATSPARSSD

SEQ ID NO: 2215 - protein, 428 aa, synthetic construct
  REGION 1..428: note = CEACAM1 (P13688) SP+PP+ECD
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPG

SEQ ID NO: 2216 - protein, 157 aa, synthetic construct
  REGION 1..157: note = CEACAM19 (Q7Z692) SP+PP+ECD
MEIPMGTQGCFSKSLLLSASILVLWMLQGSQAALYIQKIPEQPQKNQDLLLSVQGVPDTFQDFNWYLGEETYGGTRLFTYIPGIQRPQRDGSAMGQRDIVGFPNGSMLLRRAQPTDSGTYQVAITINSEWTMKAKTEVQVAEKNKELPSTHLPTNAG

SEQ ID NO: 2217 - protein, 450 aa, synthetic construct
  REGION 1..450: note = CEACAM20 (Q6UY09) SP+PP+ECD
MGPADSWGHHWMGILLSASLCTVWSPPAAAQLTLNANPLDATQSEDVVLPVFGTPRTPQIHGRSRELAKPSIAVSPGTAIEQKDMVTFYCTTKDVNITIHWVSNNLSIVFHERMQLSKDGKILTILIVQREDSGTYQCEARDALLSQRSDPIFLDVKYGPDPVEIKLESGVASGEVVEVMEGSSMTFLAETKSHPPCAYTWFLLDSILSHTTRTFTIHAVSREHEGLYRCLVSNSATHLSSLGTLKVRVLETLTMPQVVPSSLNLVENARSVDLTCQTVNQSVNVQWFLSGQPLLPSEHLQLSADNRTLIIHGLQRNDTGPYACEVWNWGSRARSEPLELTINYGPDQVHITRESASEMISTIEAELNSSLTLQCWAESKPGAEYRWTLEHSTGEHLGEQLIIRALTWEHDGIYNCTASNSLTGLARSTSVLVKVVGPQSSSLSSGAIAG

SEQ ID NO: 2218 - protein, 240 aa, synthetic construct
  REGION 1..240: note = CEACAM21 (Q3KPI0) SP+PP+ECD
MGPPSACPHRECIPWQGLLLTASLLTFWNAPTTAWLFIASAPFEVAEGENVHLSVVYLPENLYSYGWYKGKTVEPNQLIAAYVIDTHVRTPGPAYSGRETISPSGDLHFQNVTLEDTGYYTLQVTYRNSQIEQASHHLRVYESVAQPSIQASSTTVTEKGSVVLTCHTNNTGTSFQWIFNNQRLQVTKRMKLSWFNHMLTIDPIRQEDAGEYQCEVSNPVSSNRSDPLKLTVKSDDNTLG

SEQ ID NO: 2219 - protein, 155 aa, synthetic construct
  REGION 1..155: note = CEACAM3 (P40198) SP+PP+ECD
MGPPSASPHRECIPWQGLLLTASLLNFWNPPTTAKLTIESMPLSVAEGKEVLLLVHNLPQHLFGYSWYKGERVDGNSLIVGYVIGTQQATPGAAYSGRETIYTNASLLIQNVTQNDIGFYTLQVIKSDLVNEEATGQFHVYQENAPGLPVGAVAG

SEQ ID NO: 2220 - protein, 155 aa, synthetic construct
  REGION 1..155: note = CEACAM4 (O75871) SP+PP+ECD
MGPPSAAPRGGHRPWQGLLITASLLTFWHPPTTVQFTIEALPSSAAEGKDVLLLACNISETIQAYYWHKGKTAEGSPLIAGYITDIQANIPGAAYSGRETVYPNGSLLFQNITLEDAGSYTLRTINASYDSDQATGQLHVHQNNVPGLPVGAVAG

SEQ ID NO: 2221 - protein, 1082 aa, synthetic construct
  REGION 1..1082: note = CHL1 (O00533) SP+PP+ECD
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSSNSIKQRKPKLLLPPTESGSESSITILKGEILLLECFAEGLPTPQVDWNKIGGDLPKGRETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGSKGIGKISGVNLTQKTHPIEVFEPGAEHIVRLMTKNWGDNDSIFQDVIETRGREYAGLYDDISTQGW

SEQ ID NO: 2222 - protein, 216 aa, synthetic construct
  REGION 1..216: note = CHODL (Q9H9P2) SP+PP+ECD
MSRVVSLLLGAALLCGHGAFCRRVVSGQKVCFADFKHPCYKMAYFHELSSRVSFQEARLACESEGGVLLSLENEAEQKLIESMLQNLTKPGTGISDGDFWIGLWRNGDGQTSGACPDLYQWSDGSNSQYRNWYTDEPSCGSEKCVVMYHQPTANPGLGGPYLYQWNDDRCNMKHNYICKYEPEINPTAPVEKPYLTNQPGDTHQNVVVTEAGIIPN

SEQ ID NO: 2223 - protein, 901 aa, synthetic construct
  REGION 1..901: note = CLCA2 (Q9UQC9) SP+PP+ECD
MTQRSIAGPICNLKFVTLLVALSSELPFLGAGVQLQDNGYNGLLIAINPQVPENQNLISNIKEMITEASFYLFNATKRRVFFRNIKILIPATWKANNNSKIKQESYEKANVIVTDWYGAHGDDPYTLQYRGCGKEGKYIHFTPNFLLNDNLTAGYGSRGRVFVHEWAHLRWGVFDEYNNDKPFYINGQNQIKVTRCSSDITGIFVCEKGPCPQENCIISKLFKEGCTFIYNSTQNATASIMFMQSLSSVVEFCNASTHNQEAPNLQNQMCSLRSAWDVITDSADFHHSFPMNGTELPPPPTFSLVQAGDKVVCLVLDVSSKMAEADRLLQLQQAAEFYLMQIVEIHTFVGIASFDSKGEIRAQLHQINSNDDRKLLVSYLPTTVSAKTDISICSGLKKGFEVVEKLNGKAYGSVMILVTSGDDKLLGNCLPTVLSSGSTIHSIALGSSAAPNLEELSRLTGGLKFFVPDISNSNSMIDAFSRISSGTGDIFQQHIQLESTGENVKPHHQLKNTVTVDNTVGNDTMFLVTWQASGPPEIILFDPDGRKYYTNNFITNLTFRTASLWIPGTAKPGHWTYTLNNTHHSLQALKVTVTSRASNSAVPPATVEAFVERDSLHFPHPVMIYANVKQGFYPILNATVTATVEPETGDPVTLRLLDDGAGADVIKNDGIYSRYFFSFAANGRYSLKVHVNHSPSISTPAHSIPGSHAMYVPGYTANGNIQMNAPRKSVGRNEEERKWGFSRVSSGGSFSVLGVPAGPHPDVFPPCKIIDLEAVKVEEELTLSWTAPGEDFDQGQATSYEIRMSKSLQNIQDDFNNAILVNTSKRNPQQAGIREIFTFSPQISTNGPEHQPNGETHESHRIYVAIRAMDRNSLQSAVSNIAQAPLFIPPNSDPVPARDYL

SEQ ID NO: 2224 - protein, 894 aa, synthetic construct
  REGION 1..894: note = CLCA4 (Q14CN2) SP+PP+ECD
MGLFRGFVFLLVLCLLHQSNTSFIKLNNNGFEDIVIVIDPSVPEDEKIIEQIEDMVTTASTYLFEATEKRFFFKNVSILIPENWKENPQYKRPKHENHKHADVIVAPPTLPGRDEPYTKQFTECGEKGEYIHFTPDLLLGKKQNEYGPPGKLFVHEWAHLRWGVFDEYNEDQPFYRAKSKKIEATRCSAGISGRNRVYKCQGGSCLSRACRIDSTTKLYGKDCQFFPDKVQTEKASIMFMQSIDSVVEFCNEKTHNQEAPSLQNIKCNFRSTWEVISNSEDFKNTIPMVTPPPPPVFSLLKISQRIVCLVLDKSGSMGGKDRLNRMNQAAKHFLLQTVENGSWVGMVHFDSTATIVNKLIQIKSSDERNTLMAGLPTYPLGGTSICSGIKYAFQVIGELHSQLDGSEVLLLTDGEDNTASSCIDEVKQSGAIVHFIALGRAADEAVIEMSKITGGSHFYVSDEAQNNGLIDAFGALTSGNTDLSQKSLQLESKGLTLNSNAWMNDTVIIDSTVGKDTFFLITWNSLPPSISLWDPSGTIMENFTVDATSKMAYLSIPGTAKVGTWAYNLQAKANPETLTITVTSRAANSSVPPITVNAKMNKDVNSFPSPMIVYAEILQGYVPVLGANVTAFIESQNGHTEVLELLDNGAGADSFKNDGVYSRYFTAYTENGRYSLKVRAHGGANTARLKLRPPLNRAAYIPGWVVNGEIEANPPRPEIDEDTQTTLEDFSRTASGGAFVVSQVPSLPLPDQYPPSQITDLDATVHEDKIILTWTAPGDNFDVGKVQRYIIRISASILDLRDSFDDALQVNTTDLSPKEANSKESFAFKPENISEENATHIFIAIKSIDKSNLTSKVSNIAQVTLFIPQANPDDIDPTPTPTPTPTPDKSHNSG

SEQ ID NO: 2225 - protein, 397 aa, synthetic construct
  REGION 1..397: note = CLEC14A (Q86T13) SP+PP+ECD
MRPAFALCLLWQALWPGPGGGEHPTADRAGCSASGACYSLHHATMKRQAAEEACILRGGALSTVRAGAELRAVLALLRAGPGPGGGSKDLLFWVALERRRSHCTLENEPLRGFSWLSSDPGGLESDTLQWVEEPQRSCTARRCAVLQATGGVEPAGWKEMRCHLRANGYLCKYQFEVLCPAPRPGAASNLSYRAPFQLHSAALDFSPPGTEVSALCRGQLPISVTCIADEIGARWDKLSGDVLCPCPGRYLRAGKCAELPNCLDDLGGFACECATGFELGKDGRSCVTSGEGQPTLGGTGVPTRRPPATATSPVPQRTWPIRVDEKLGETPLVPEQDNSVTSIPEIPRWGSQSTMSTLQMSLQAESKATITPSGSVISKFNSTTSSATPQAFDSSSA

SEQ ID NO: 2226 - protein, 235 aa, synthetic construct
  REGION 1..235: note = CLMP (Q9H6B4) SP+PP+ECD
MSLLLLLLLVSYYVGTLGTHTEIKRVAEEKVTLPCHHQLGLPEKDTLDIEWLLTDNEGNQKVVITYSSRHVYNNLTEEQKGRVAFASNFLAGDASLQIEPLKPSDEGRYTCKVKNSGRYVWSHVILKVLVRPSKPKCELEGELTEGSDLTLQCESSSGTEPIVYYWQRIREKEGEDERLPPKSRIDYNHPGRVLLQNLTMSYSGLYQCTAGNEAGKESCVVRVTVQYVQSIGMVA

SEQ ID NO: 2227 - protein, 859 aa, synthetic construct
  REGION 1..859: note = CLSTN1 (O94985) SP+PP+ECD
MLRRPAPALAPAARLLLAGLLCGGGVWAARVNKHKPWLEPTYHGIVTENDNTVLLDPPLIALDKDAPLRFAESFEVTVTKEGEICGFKIHGQNVPFDAVVVDKSTGEGVIRSKEKLDCELQKDYSFTIQAYDCGKGPDGTNVKKSHKATVHIQVNDVNEYAPVFKEKSYKATVIEGKQYDSILRVEAVDADCSPQFSQICSYEIITPDVPFTVDKDGYIKNTEKLNYGKEHQYKLTVTAYDCGKKRATEDVLVKISIKPTCTPGWQGWNNRIEYEPGTGALAVFPNIHLETCDEPVASVQATVELETSHIGKGCDRDTYSEKSLHRLCGAAAGTAELLPSPSGSLNWTMGLPTDNGHDSDQVFEFNGTQAVRIPDGVVSVSPKEPFTISVWMRHGPFGRKKETILCSSDKTDMNRHHYSLYVHGCRLIFLFRQDPSEEKKYRPAEFHWKLNQVCDEEWHHYVLNVEFPSVTLYVDGTSHEPFSVTEDYPLHPSKIETQLVVGACWQEFSGVENDNETEPVTVASAGGDLHMTQFFRGNLAGLTLRSGKLADKKVIDCLYTCKEGLDLQVLEDSGRGVQIQAHPSQLVLTLEGEDLGELDKAMQHISYLNSRQFPTPGIRRLKITSTIKCFNEATCISVPPVDGYVMVLQPEEPKISLSGVHHFARAASEFESSEGVFLFPELRIISTITREVEPEGDGAEDPTVQESLVSEEIVHDLDTCEVTVEGEELNHEQESLEVDMARLQQKGIEVSSSELGMTFTGVDTMASYEEVLHLLRYRNWHARSLLDRKFKLICSELNGRYISNEFKVEVNVIHTANPMEHANHMAAQPQFVHPEHRSFVDLSGHNLANPHPFAVVPST

SEQ ID NO: 2228 - protein, 831 aa, synthetic construct
  REGION 1..831: note = CLSTN2 (Q9H4D0) SP+PP+ECD
MLPGRLCWVPLLLALGVGSGSGGGGDSRQRRLLAAKVNKHKPWIETSYHGVITENNDTVILDPPLVALDKDAPVPFAGEICAFKIHGQELPFEAVVLNKTSGEGRLRAKSPIDCELQKEYTFIIQAYDCGAGPHETAWKKSHKAVVHIQVKDVNEFAPTFKEPAYKAVVTEGKIYDSILQVEAIDEDCSPQYSQICNYEIVTTDVPFAIDRNGNIRNTEKLSYDKQHQYEILVTAYDCGQKPAAQDTLVQVDVKPVCKPGWQDWTKRIEYQPGSGSMPLFPSIHLETCDGAVSSLQIVTELQTNYIGKGCDRETYSEKSLQKLCGASSGIIDLLPSPSAATNWTAGLLVDSSEMIFKFDGRQGAKVPDGIVPKNLTDQFTITMWMKHGPSPGVRAEKETILCNSDKTEMNRHHYALYVHNCRLVFLLRKDFDQADTFRPAEFHWKLDQICDKEWHYYVINVEFPVVTLYMDGATYEPYLVTNDWPIHPSHIAMQLTVGACWQGGEVTKPQFAQFFHGSLASLTIRPGKMESQKVISCLQACKEGLDINSLESLGQGIKYHFNPSQSILVMEGDDIGNINRALQKVSYINSRQFPTAGVRRLKVSSKVQCFGEDVCISIPEVDAYVMVLQAIEPRITLRGTDHFWRPAAQFESARGVTLFPDIKIVSTFAKTEAPGDVKTTDPKSEVLEEMLHNLDFCDILVIGGDLDPRQECLELNHSELHQRHLDATNSTAGYSIYGVGSMSRYEQVLHHIRYRNWRPASLEARRFRIKCSELNGRYTSNEFNLEVSILHEDQVSDKEHVNHLIVQPPFLQSVHHPESRSSIQHSSVVPS

SEQ ID NO: 2229 - protein, 847 aa, synthetic construct
  REGION 1..847: note = CLSTN3 (Q9BQT9) SP+PP+ECD
MTLLLLPLLLASLLASCSCNKANKHKPWIEAEYQGIVMENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRVEAIDGDCSPQYSQICYYEILTPNTPFLIDNDGNIENTEKLQYSGERLYKFTVTAYDCGKKRAADDAEVEIQVKPTCKPSWQGWNKRIEYAPGAGSLALFPGIRLETCDEPLWNIQATIELQTSHVAKGCDRDNYSERALRKLCGAATGEVDLLPMPGPNANWTAGLSVHYSQDSSLIYWFNGTQAVQVPLGGPSGLGSGPQDSLSDHFTLSFWMKHGVTPNKGKKEEETIVCNTVQNEDGFSHYSLTVHGCRIAFLYWPLLESARPVKFLWKLEQVCDDEWHHYALNLEFPTVTLYTDGISFDPALIHDNGLIHPPRREPALMIGACWTEEKNKEKEKGDNSTDTTQGDPLSIHHYFHGYLAGFSVRSGRLESREVIECLYACREGLDYRDFESLGKGMKVHVNPSQSLLTLEGDDVETFNHALQHVAYMNTLRFATPGVRPLRLTTAVKCFSEESCVSIPEVEGYVVVLQPDAPQILLSGTAHFARPAVDFEGTNGVPLFPDLQITCSISHQVEAKKDESWQGTVTDTRMSDEIVHNLDGCEISLVGDDLDPERESLLLDTTSLQQRGLELTNTSAYLTIAGVESITVYEEILRQARYRLRHGAALYTRKFRLSCSEMNGRYSSNEFIVEVNVLHSMNRVAHPSHVLSSQQFLHRGHQPPPEMAGHSLASSHRNSMIPSA

SEQ ID NO: 2230 - protein, 1283 aa, synthetic construct
  REGION 1..1283: note = CNTNAP1 (P78357) SP+PP+ECD
MMHLRLFCILLAAVSGAEGWGYYGCDEELVGPLYARSLGASSYYSLLTAPRFARLHGISGWSPRIGDPNPWLQIDLMKKHRIRAVATQGSFNSWDWVTRYMLLYGDRVDSWTPFYQRGHNSTFFGNVNESAVVRHDLHFHFTARYIRIVPLAWNPRGKIGLRLGLYGCPYKADILYFDGDDAISYRFPRGVSRSLWDVFAFSFKTEEKDGLLLHAEGAQGDYVTLELEGAHLLLHMSLGSSPIQPRPGHTTVSAGGVLNDQHWHYVRVDRFGRDVNFTLDGYVQRFILNGDFERLNLDTEMFIGGLVGAARKNLAYRHNFRGCIENVIFNRVNIADLAVRRHSRITFEGKVAFRCLDPVPHPINFGGPHNFVQVPGFPRRGRLAVSFRFRTWDLTGLLLFSRLGDGLGHVELTLSEGQVNVSIAQSGRKKLQFAAGYRLNDGFWHEVNFVAQENHAVISIDDVEGAEVRVSYPLLIRTGTSYFFGGCPKPASRWDCHSNQTAFHGCMELLKVDGQLVNLTLVEGRRLGFYAEVLFDTCGITDRCSPNMCEHDGRCYQSWDDFICYCELTGYKGETCHTPLYKESCEAYRLSGKTSGNFTIDPDGSGPLKPFVVYCDIRENRAWTVVRHDRLWTTRVTGSSMERPFLGAIQYWNASWEEVSALANASQHCEQWIEFSCYNSRLLNTAGGYPYSFWIGRNEEQHFYWGGSQPGIQRCACGLDRSCVDPALYCNCDADQPQWRTDKGLLTFVDHLPVTQVVIGDTNRSTSEAQFFLRPLRCYGDRNSWNTISFHTGAALRFPPIRANHSLDVSFYFRTSAPSGVFLENMGGPYCQWRRPYVRVELNTSRDVVFAFDVGNGDENLTVHSDDFEFNDDEWHLVRAEINVKQARLRVDHRPWVLRPMPLQTYIWMEYDQPLYVGSAELKRRPFVGCLRAMRLNGVTLNLEGRANASEGTSPNCTGHCAHPRLPCFHGGRCVERYSYYTCDCDLTAFDGPYCNHDIGGFFEPGTWMRYNLQSALRSAAREFSHMLSRPVPGYEPGYIPGYDTPGYVPGYHGPGYRLPDYPRPGRPVPGYRGPVYNVTGEEVSFSFSTSSAPAVLLYVSSFVRDYMAVLIKDDGTLQLRYQLGTSPYVYQLTTRPVTDGQPHSINITRVYRNLFIQVDYFPLTEQKFSLLVDSQLDSPKALYLGRVMETGVIDPEIQRYNTPGFSGCLSGVRFNNVAPLKTHFRTPRPMTAELAEALRVQGELSESNCGAMPRLVSEVPPELDPWYLPPDFPYYHDEGWVA

SEQ ID NO: 2231 - protein, 1262 aa, synthetic construct
  REGION 1..1262: note = CNTNAP2 (Q9UHC6) SP+PP+ECD
MQAAPRAGCGAALLLWIVSSCLCRAWTAPSTSQKCDEPLVSGLPHVAFSSSSSISGSYSPGYAKINKRGGAGGWSPSDSDHYQWLQVDFGNRKQISAIATQGRYSSSDWVTQYRMLYSDTGRNWKPYHQDGNIWAFPGNINSDGVVRHELQHPIIARYVRIVPLDWNGEGRIGLRIEVYGCSYWADVINFDGHVVLPYRFRNKKMKTLKDVIALNFKTSESEGVILHGEGQQGDYITLELKKAKLVLSLNLGSNQLGPIYGHTSVMTGSLLDDHHWHSVVIERQGRSINLTLDRSMQHFRTNGEFDYLDLDYEITFGGIPFSGKPSSSSRKNFKGCMESINYNGVNITDLARRKKLEPSNVGNLSFSCVEPYTVPVFFNATSYLEVPGRLNQDLFSVSFQFRTWNPNGLLVFSHFADNLGNVEIDLTESKVGVHINITQTKMSQIDISSGSGLNDGQWHEVRFLAKENFAILTIDGDEASAVRTNSPLQVKTGEKYFFGGFLNQMNNSSHSVLQPSFQGCMQLIQVDDQLVNLYEVAQRKPGSFANVSIDMCAIIDRCVPNHCEHGGKCSQTWDSFKCTCDETGYSGATCHNSIYEPSCEAYKHLGQTSNYYWIDPDGSGPLGPLKVYCNMTEDKVWTIVSHDLQMQTPVVGYNPEKYSVTQLVYSASMDQISAITDSAEYCEQYVSYFCKMSRLLNTPDGSPYTWWVGKANEKHYYWGGSGPGIQKCACGIERNCTDPKYYCNCDADYKQWRKDAGFLSYKDHLPVSQVVVGDTDRQGSEAKLSVGPLRCQGDRNYWNAASFPNPSSYLHFSTFQGETSADISFYFKTLTPWGVFLENMGKEDFIKLELKSATEVSFSFDVGNGPVEIVVRSPTPLNDDQWHRVTAERNVKQASLQVDRLPQQIRKAPTEGHTRLELYSQLFVGGAGGQQGFLGCIRSLRMNGVTLDLEERAKVTSGFISGCSGHCTSYGTNCENGGKCLERYHGYSCDCSNTAYDGTFCNKDVGAFFEEGMWLRYNFQAPATNARDSSSRVDNAPDQQNSHPDLAQEEIRFSFSTTKAPCILLYISSFTTDFLAVLVKPTGSLQIRYNLGGTREPYNIDVDHRNMANGQPHSVNITRHEKTIFLKLDHYPSVSYHLPSSSDTLFNSPKSLFLGKVIETGKIDQEIHKYNTPGFTGCLSRVQFNQIAPLKAALRQTNASAHVHIQGELVESNCGASPLTLSPMSSATDPWHLDHLDSASADFPYNPGQGQAIRNGVNRNSA

SEQ ID NO: 2232 - protein, 1245 aa, synthetic construct
  REGION 1..1245: note = CNTNAP3 (Q9BZ76) SP+PP+ECD
MASVAWAVLKVLLLLPTQTWSPVGAGNPPDCDAPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYRLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSYLDLNFEISFGGIPTPGRSRAFRRKSFHGCLENLYYNGVDVTELAKKHKPQILMMGNVSFSCPQPQTVPVTFLSSRSYLALPGNSGEDKVSVTFQFRTWNRAGHLLFGELRRGSGSFVLFLKDGKLKLSLFQPGQSPRNVTAGAGLNDGQWHSVSFSAKWSHMNVVVDDDTAVQPLVAVLIDSGDTYYFGGCLDNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTADAAWTVVQHGGPDAVTLRGAPSGHPRSAVSFAYAAGAGQLRSAVNLAERCEQRLALRCGTARRPDSRDGTPLSWWVGRTNETHTSWGGSLPDAQKCTCGLEGNCIDSQYYCNCDAGRNEWTSDTIVLSQKEHLPVTQIVMTDAGRPHSEAAYTLGPLLCRGDQSFWNSASFNTETSYLHFPAFHGELTADVCFFFKTTVSSGVFMENLGITDFIRIELRAPTEVTFSFDVGNGPCEVTVQSPTPFNDNQWHHVRAERNVKGASLQVDQLPQKMQPAPADGHVRLQLNSQLFIGGTATRQRGFLGCIRSLQLNGVALDLEERATVTPGVEPGCAGHCSTYGHLCRNGGRCREKRRGVTCDCAFSAYDGPFCSNEISAYFATGSSMTYHFQEHYTLSENSSSLVSSLHRDVTLTREMITLSFRTTRTPSLLLYVSSFYEEYLSVILANNGSLQIRYKLDRHQNPDAFTFDFKNMADGQLHQVKINREEAVVMVEVNQSTKKQVILSSGTEFNAVKSLILGKVLEAAGADPDTRRAATSGFTGCLSAVRFGRAAPLKAALRPSGPSRVTVRGHVAPMARCAAGAASGSPARELAPRLAGGAGRSGPADEGEPLVNADRRDSA

SEQ ID NO: 2233 - protein, 1245 aa, synthetic construct
  REGION 1..1245: note = CNTNAP3B (Q96NU0) SP+PP+ECD
MASVAWAVLKVLLLLPTQTWSPVGAGNPPDCDSPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYTLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSNLDLNFEISFGGILSPGRSRAFTRKSFHGCLENLYYNGVDVTELAKKHKPQILMMGNVSFSCPQPQTVPVTFLSSRSYLALPGNSGEDKVSVTFQFRTWNRAGHLLFGELQRGSGSFVLFLKDGKLKLSLFQAGQSPRNVTAGAGLNDGQWHSVSFSAKWSHMNVVVDDDTAVQPLVAVLIDSGDTYYFGGCLGNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTADSAWTVVRHGGPDAVTLRGAPSGHPLSAVSFAYAAGAGQLRAAVNLAERCEQRLALRCGTARRPDSRDGTPLSWWVGRTNETHTSWGGSLPDAQKCTCGLEGNCIDSQYYCNCDAGQNEWTSDTIVLSQKEHLPVTQIVMTDTGQPHSEADYTLGPLLCRGDKSFWNSASFNTETSYLHFPAFHGELTADVCFFFKTTVSSGVFMENLGITDFIRIELRAPTEVTFSFDVGNGPCEVTVQSPTPFNDNQWHHVRAERNVKGASLQVDQLPQKMQPAPADGHVRLQLNSQLFIGGTATRQRGFLGCIRSLQLNGVALDLEERATVTPGVEPGCAGHCSTYGHLCRNGGRCREKRRGVTCDCAFSAYDGPFCSNEISAYFATGSSMTYHFQEHYTLSENSSSLVSSLHRDVTLTREMITLSFRTTRTPSLLLYVSSFYEEYLSVILANNGSLQIRYKLDRHQNPDAFTFDFKNMADGQLHQVKINREEAVVMVEVNQSAKKQVILSSGTEFNAVKSLILGKVLEAAGADPDTRRAATSGFTGCLSAVRFGCAAPLKAALRPSGPSRVTVRGHVAPMARCAAGAASGSPARELAPRLAGGAGRSGPVDEGEPLVNADRRDSA

SEQ ID NO: 2234 - protein, 1241 aa, synthetic construct
  REGION 1..1241: note = CNTNAP4 (Q9C0A0) SP+PP+ECD
MGSVTGAVLKTLLLLSTQNWNRVEAGNSYDCDDPLVSALPQASFSSSSELSSSHGPGFARLNRRDGAGGWSPLVSNKYQWLQIDLGERMEVTAVATQGGYGSSNWVTSYLLMFSDSGWNWKQYRQEDSIWGFSGNANADSVVYYRLQPSIKARFLRFIPLEWNPKGRIGMRIEVFGCAYRSEVVDLDGKSSLLYRFDQKSLSPIKDIISLKFKTMQSDGILLHREGPNGDHITLQLRRARLFLLINSGEAKLPSTSTLVNLTLGSLLDDQHWHSVLIQRLGKQVNFTVDEHRHHFHARGEFNLMNLDYEISFGGIPAPGKSVSFPHRNFHGCLENLYYNGVDIIDLAKQQKPQIIAMGNVSFSCSQPQSMPVTFLSSRSYLALPDFSGEEEVSATFQFRTWNKAGLLLFSELQLISGGILLFLSDGKLKSNLYQPGKLPSDITAGVELNDGQWHSVSLSAKKNHLSVAVDGQMASAAPLLGPEQIYSGGTYYFGGCPDKSFGSKCKSPLGGFQGCMRLISISGKVVDLISVQQGSLGNFSDLQIDSCGISDRCLPNYCEHGGECSQSWSTFHCNCTNTGYRGATCHNSIYEQSCEAYKHRGNTSGFYYIDSDGSGPLEPFLLYCNMTETAWTIIQHNGSDLTRVRNTNPENPYAGFFEYVASMEQLQATINRAEHCEQEFTYYCKKSRLVNKQDGTPLSWWVGRTNETQTYWGGSSPDLQKCTCGLEGNCIDSQYYCNCDADRNEWTNDTGLLAYKEHLPVTKIVITDTGRLHSEAAYKLGPLLCQGDRSFWNSASFDTEASYLHFPTFHGELSADVSFFFKTTASSGVFLENLGIADFIRIELRSPTVVTFSFDVGNGPFEISVQSPTHFNDNQWHHVRVERNMKEASLQVDQLTPKTQPAPADGHVLLQLNSQLFVGGTATRQRGFLGCIRSLQLNGMTLDLEERAQVTPEVQPGCRGHCSSYGKLCRNGGKCRERPIGFFCDCTFSAYTGPFCSNEISAYFGSGSSVIYNFQENYLLSKNSSSHAASFHGDMKLSREMIKFSFRTTRTPSLLLFVSSFYKEYLSVIIAKNGSLQIRYKLNKYQEPDVVNFDFKNMADGQLHHIMINREEGVVFIEIDDNRRRQVHLSSGTEFSAVKSLVLGRILEHSDVDQDTALAGAQGFTGCLSAVQLSHVAPLKAALHPSHPDPVTVTGHVTESSCMAQPGTDATSRERTHSFADHSGTIDDREPLANAIKSDSA

SEQ ID NO: 2235 - protein, 1237 aa, synthetic construct
  REGION 1..1237: note = CNTNAP5 (Q8WYK1) SP+PP+ECD
MDSLPRLTSVLTLLFSGLWHLGLTATNYNCDDPLASLLSPMAFSSSSDLTGTHSPAQLNWRVGTGGWSPADSNAQQWLQMDLGNRVEITAVATQGRYGSSDWVTSYSLMFSDTGRNWKQYKQEDSIWTFAGNMNADSVVHHKLLHSVRARFVRFVPLEWNPSGKIGMRVEVYGCSYKSDVADFDGRSSLLYRFNQKLMSTLKDVISLKFKSMQGDGVLFHGEGQRGDHITLELQKGRLALHLNLGDSKARLSSSLPSATLGSLLDDQHWHSVLIERVGKQVNFTVDKHTQHFRTKGETDALDIDYELSFGGIPVPGKPGTFLKKNFHGCIENLYYNGVNIIDLAKRRKHQIYTGNVTFSCSEPQIVPITFVNSSGSYLLLPGTPQIDGLSVSFQFRTWNKDGLLLSTELSEGSGTLLLSLEGGILRLVIQKMTERVAEILTGSNLNDGLWHSVSINARRNRITLTLDDEAAPPAPDSTWVQIYSGNSYYFGGCPDNLTDSQCLNPIKAFQGCMRLIFIDNQPKDLISVQQGSLGNFSDLHIDLCSIKDRCLPNYCEHGGSCSQSWTTFYCNCSDTSYTGATCHNSIYEQSCEVYRHQGNTAGFFYIDSDGSGPLGPLQVYCNITEDKIWTSVQHNNTELTRVRGANPEKPYAMALDYGGSMEQLEAVIDGSEHCEQEVAYHCRRSRLLNTPDGTPFTWWIGRSNERHPYWGGSPPGVQQCECGLDESCLDIQHFCNCDADKDEWTNDTGFLSFKDHLPVTQIVITDTDRSNSEAAWRIGPLRCYGDRRFWNAVSFYTEASYLHFPTFHAEFSADISFFFKTTALSGVFLENLGIKDFIRLEISSPSEITFAIDVGNGPVELVVQSPSLLNDNQWHYVRAERNLKETSLQVDNLPRSTRETSEEGHFRLQLNSQLFVGGTSSRQKGFLGCIRSLHLNGQKMDLEERAKVTSGVRPGCPGHCSSYGSICHNGGKCVEKHNGYLCDCTNSPYEGPFCKKEVSAVFEAGTSVTYMFQEPYPVTKNISLSSSAIYTDSAPSKENIALSFVTTQAPSLLLFINSSSQDFVVVLLCKNGSLQVRYHLNKEETHVFTIDADNFANRRMHHLKINREGRELTIQMDQQLRLSYNFSPEVEFRVIRSLTLGKVTENLGLDSEVAKANAMGFAGCMSSVQYNHIAPLKAALRHATVAPVTVHGTLTESSCGFMVDSDVNAVTTVHSSSDPFGKTDEREPLTNAVRSDS

SEQ ID NO: 2236 - protein, 1299 aa, synthetic construct
  REGION 1..1299: note = CPD (O75976) SP+PP+ECD
MASGRDERPPWRLGRLLLLMCLLLLGSSARAAHIKKAEATTTTTSAGAEAAEGQFDRYYHEEELESALREAAAAGLPGLARLFSIGRSVEGRPLWVLRLTAGLGSLIPEGDAGPDAAGPDAAGPLLPGRPQVKLVGNMHGDETVSRQVLIYLARELAAGYRRGDPRLVRLLNTTDVYLLPSLNPDGFERAREGDCGFGDGGPSGASGRDNSRGRDLNRSFPDQFSTGEPPALDEVPEVRALIEWIRRNKFVLSGNLHGGSVVASYPFDDSPEHKATGIYSKTSDDEVFKYLAKAYASNHPIMKTGEPHCPGDEDETFKDGITNGAHWYDVEGGMQDYNYVWANCFEITLELSCCKYPPASQLRQEWENNRESLITLIEKVHIGVKGFVKDSITGSGLENATISVAGINHNITTGRFGDFYRLLVPGTYNLTVVLTGYMPLTVTNVVVKEGPATEVDFSLRPTVTSVIPDTTEAVSTASTVAIPNILSGTSSSYQPIQPKDFHHHHFPDMEIFLRRFANEYPNITRLYSLGKSVESRELYVMEISDNPGVHEPGEPEFKYIGNMHGNEVVGRELLLNLIEYLCKNFGTDPEVTDLVHNTRIHLMPSMNPDGYEKSQEGDSISVIGRNNSNNFDLNRNFPDQFVQITDPTQPETIAVMSWMKSYPFVLSANLHGGSLVVNYPFDDDEQGLATYSKSPDDAVFQQIALSYSKENSQMFQGRPCKNMYPNEYFPHGITNGASWYNVPGGMQDWNYLQTNCFEVTIELGCVKYPLEKELPNFWEQNRRSLIQFMKQVHQGVRGFVLDATDGRGILNATISVAEINHPVTTYKTGDYWRLLVPGTYKITASARGYNPVTKNVTVKSEGAIQVNFTLVRSSTDSNNESKKGKGASSSTNDASDPTTKEFETLIKDLSAENGLESLMLRSSSNLALALYRYHSYKDLSEFLRGLVMNYPHITNLTNLGQSTEYRHIWSLEISNKPNVSEPEEPKIRFVAGIHGNAPVGTELLLALAEFLCLNYKKNPAVTQLVDRTRIVIVPSLNPDGRERAQEKDCTSKIGQTNARGKDLDTDFTNNASQPETKAIIENLIQKQDFSLSVALDGGSMLVTYPYDKPVQTVENKETLKHLASLYANNHPSMHMGQPSCPNKSDENIPGGVMRGAEWHSHLGSMKDYSVTYGHCPEITVYTSCCYFPSAARLPSLWADNKRSLLSMLVEVHKGVHGFVKDKTGKPISKAVIVLNEGIKVQTKEGGYFHVLLAPGVHNIIAIADGYQQQHSQVFVHHDAASSVVIVFDTDNRIFGLPRE

SEQ ID NO: 2237 - protein, 1971 aa, synthetic construct
  REGION 1..1971: note = CR1 (P17927) SP+PP+ECD
MGASSPRSPEPVGPPAPGLPFCCGGSLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPEILHGEHTPSHQDNFSPGQEVFYSCEPGYDLRGAASLHCTPQGDWSPEAPRCAVKSCDDFLGQLPHGRVLFPLNLQLGAKVSFVCDEGFRLKGSSVSHCVLVGMRSLWNNSVPVCEHIFCPNPPAILNGRHTGTPSGDIPYGKEISYTCDPHPDRGMTFNLIGESTIRCTSDPHGNGVWSSPAPRCELSVRAGHCKTPEQFPFASPTIPINDFEFPVGTSLNYECRPGYFGKMFSISCLENLVWSSVEDNCRRKSCGPPPEPFNGMVHINTDTQFGSTVNYSCNEGFRLIGSPSTTCLVSGNNVTWDKKAPICEIISCEPPPTISNGDFYSNNRTSFHNGTVVTYQCHTGPDGEQLFELVGERSIYCTSKDDQVGVWSSPPPRCISTNKCTAPEVENAIRVPGNRSFFSLTEIIRFRCQPGFVMVGSHTVQCQTNGRWGPKLPHCSRVCQPPPEILHGEHTLSHQDNFSPGQEVFYSCEPSYDLRGAASLHCTPQGDWSPEAPRCTVKSCDDFLGQLPHGRVLLPLNLQLGAKVSFVCDEGFRLKGRSASHCVLAGMKALWNSSVPVCEQIFCPNPPAILNGRHTGTPFGDIPYGKEISYACDTHPDRGMTFNLIGESSIRCTSDPQGNGVWSSPAPRCELSVPAACPHPPKIQNGHYIGGHVSLYLPGMTISYICDPGYLLVGKGFIFCTDQGIWSQLDHYCKEVNCSFPLFMNGISKELEMKKVYHYGDYVTLKCEDGYTLEGSPWSQCQADDRWDPPLAKCTSRTHD

SEQ ID NO: 2238 - protein, 971 aa, synthetic construct
  REGION 1..971: note = CR2 (P20023) SP+PP+ECD
MGAAGLLGVFLALVAPGVLGISCGSPPPILNGRISYYSTPIAVGTVIRYSCSGTFRLIGEKSLLCITKDKVDGTWDKPAPKCEYFNKYSSCPEPIVPGGYKIRGSTPYRHGDSVTFACKTNFSMNGNKSVWCQANNMWGPTRLPTCVSVFPLECPALPMIHNGHHTSENVGSIAPGLSVTYSCESGYLLVGEKIINCLSSGKWSAVPPTCEEARCKSLGRFPNGKVKEPPILRVGVTANFFCDEGYRLQGPPSSRCVIAGQGVAWTKMPVCEEIFCPSPPPILNGRHIGNSLANVSYGSIVTYTCDPDPEEGVNFILIGESTLRCTVDSQKTGTWSGPAPRCELSTSAVQCPHPQILRGRMVSGQKDRYTYNDTVIFACMFGFTLKGSKQIRCNAQGTWEPSAPVCEKECQAPPNILNGQKEDRHMVRFDPGTSIKYSCNPGYVLVGEESIQCTSEGVWTPPVPQCKVAACEATGRQLLTKPQHQFVRPDVNSSCGEGYKLSGSVYQECQGTIPWFMEIRLCKEITCPPPPVIYNGAHTGSSLEDFPYGTTVTYTCNPGPERGVEFSLIGESTIRCTSNDQERGTWSGPAPLCKLSLLAVQCSHVHIANGYKISGKEAPYFYNDTVTFKCYSGFTLKGSSQIRCKADNTWDPEIPVCEKETCQHVRQSLQELPAGSRVELVNTSCQDGYQLTGHAYQMCQDAENGIWFKKIPLCKVIHCHPPPVIVNGKHTGMMAENFLYGNEVSYECDQGFYLLGEKKLQCRSDSKGHGSWSGPSPQCLRSPPVTRCPNPEVKHGYKLNKTHSAYSHNDIVYVDCNPGFIMNGSRVIRCHTDNTWVPGVPTCIKKAFIGCPPPPKTPNGNHTGGNIARFSPGMSILYSCDQGYLLVGEALLLCTHEGTWSQPAPHCKEVNCSSPADMDGIQKGLEPRKMYQYGAVVTLECEDGYMLEGSPQSQCQSDHQWNPPLAVCRSR

SEQ ID NO: 2239 - protein, 1347 aa, synthetic construct
  REGION 1..1347: note = CRB1 (P82279) SP+PP+ECD
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTT

SEQ ID NO: 2240 - protein, 1224 aa, synthetic construct
  REGION 1..1224: note = CRB2 (Q5IJ48) SP+PP+ECD
MALARPGTPDPQALASVLLLLLWAPALSLLAGTVPSEPPSACASDPCAPGTECQATESGGYTCGPMEPRGCATQPCHHGALCVPQGPDPTGFRCYCVPGFQGPRCELDIDECASRPCHHGATCRNLADRYECHCPLGYAGVTCEMEVDECASAPCLHGGSCLDGVGSFRCVCAPGYGGTRCQLDLDECQSQPCAHGGTCHDLVNGFRCDCAGTGYEGTHCEREVLECASAPCEHNASCLEGLGSFRCLCWPGYSGELCEVDEDECASSPCQHGGRCLQRSDPALYGGVQAAFPGAFSFRHAAGFLCHCPPGFEGADCGVEVDECASRPCLNGGHCQDLPNGFQCHCPDGYAGPTCEEDVDECLSDPCLHGGTCSDTVAGYICRCPETWGGRDCSVQLTGCQGHTCPLAATCIPIFESGVHSYVCHCPPGTHGPFCGQNTTFSVMAGSPIQASVPAGGPLGLALRFRTTLPAGTLATRNDTKESLELALVAATLQATLWSYSTTVLVLRLPDLALNDGHWHQVEVVLHLATLELRLWHEGCPARLCVASGPVALASTASATPLPAGISSAQLGDATFAGCLQDVRVDGHLLLPEDLGENVLLGCERREQCRPLPCVHGGSCVDLWTHFRCDCARPHRGPTCADEIPAATFGLGGAPSSASFLLQELPGPNLTVSFLLRTRESAGLLLQFANDSAAGLTVFLSEGRIRAEVPGSPAVVLPGRWDDGLRHLVMLSFGPDQLQDLGQHVHVGGRLLAADSQPWGGPFRGCLQDLRLDGCHLPFFPLPLDNSSQPSELGGRQSWNLTAGCVSEDMCSPDPCFNGGTCLVTWNDFHCTCPANFTGPTCAQQLWCPGQPCLPPATCEEVPDGFVCVAEATFREGPPAAFSGHNASSGRLLGGLSLAFRTRDSEAWLLRAAAGALEGVWLAVRNGSLAGGVRGGHGLPGAVLPIPGPRVADGAWHRVRLAMERPAATTSRWLLWLDGAATPVALRGLASDLGFLQGPGAVRILLAENFTGCLGRVALGGLPLPLARPRPGAAPGAREHFASWPGTPAPILGCRGAPVCAPSPCLHDGACRDLFDAFACACGPGWEGPRCEAHVDPCHSAPCARGRCHTHPDGRFECRCPPGFGGPRCRLPVPSKECSLNVTCLDGSPCEGGSPAANCSCLEGLAGQRCQVPTLPCEANPCLNGGTCRAAGGVSECICNARFSGQFCEVAKGLPLPLPFPLLE

SEQ ID NO: 2241 - protein, 59 aa, synthetic construct
  REGION 1..59: note = CRB3 (Q9BUF7) SP+PP+ECD
MANPGLGLLLALGLPFLLARWGRAWGQIQTTSANENSTVLPSSTSSSSDGNLRPEAITA

SEQ ID NO: 2242 - protein, 939 aa, synthetic construct
  REGION 1..939: note = CRIM1 (Q9NZV1) SP+PP+ECD
MYLVAGDRGLAGCGHLLVSLLGLLLLLARSGTRALVCLPCDESKCEEPRNCPGSIVQGVCGCCYTCASQRNESCGGTFGIYGTCDRGLRCVIRPPLNGDSLTEYEAGVCEDENWTDDQLLGFKPCNENLIAGCNIINGKCECNTIRTCSNPFEFPSQDMCLSALKRIEEEKPDCSKARCEVQFSPRCPEDSVLIEGYAPPGECCPLPSRCVCNPAGCLRKVCQPGNLNILVSKASGKPGECCDLYECKPVFGVDCRTVECPPVQQTACPPDSYETQVRLTADGCCTLPTRCECLSGLCGFPVCEVGSTPRIVSRGDGTPGKCCDVFECVNDTKPACVFNNVEYYDGDMFRMDNCRFCRCQGGVAICFTAQCGEINCERYYVPEGECCPVCEDPVYPFNNPAGCYANGLILAHGDRWREDDCTFCQCVNGERHCVATVCGQTCTNPVKVPGECCPVCEEPTIITVDPPACGELSNCTLTGKDCINGFKRDHNGCRTCQCINTEELCSERKQGCTLNCPFGFLTDAQNCEICECRPRPKKCRPIICDKYCPLGLLKNKHGCDICRCKKCPELSCSKICPLGFQQDSHGCLICKCREASASAGPPILSGTCLTVDGHHHKNEESWHDGCRECYCLNGREMCALITCPVPACGNPTIHPGQCCPSCADDFVVQKPELSTPSICHAPGGEYFVEGETWNIDSCTQCTCHSGRVLCETEVCPPLLCQNPSRTQDSCCPQCTDQPFRPSLSRNNSVPNYCKNDEGDIFLAAESWKPDVCTSCICIDSVISCFSESCPSVSCERPVLRKGQCCPYCIEDTIPKKVVCHFSGKAYADEERWDLDSCTHCYCLQGQTLCSTVSCPPLPCVEPINVEGSCCPMCPEMYVPEPTNIPIEKTNHRGEVDLEVPLWPTPSENDIVHLPRDMGHLQVDYRDNRLHPSEDSSLDS

SEQ ID NO: 2243 - protein, 231 aa, synthetic construct
  REGION 1..231: note = CRLF2 (Q9HC73) SP+PP+ECD
MGRLVLLWGAAVFLLGGWMALGQGGAAEGVQIQIIYFNLETVQVTWNASKYSRTNLTFHYRFNGDEAYDQCTNYLLQEGHTSGCLLDAEQRDDILYFSIRNGTHPVFTASRWMVYYLKPSSPKHVRFSWHQDAVTVTCSDLSYGDLLYEVQYRSPFDTEWQSKQENTCNVTIEGLDAEKCYSFWVRVKAMEDVYGPDTYPSDWSEVTCWQRGEIRDACAETPTPPKPKLSK

SEQ ID NO: 2244 - protein, 287 aa, synthetic construct
  REGION 1..287: note = CRTAM (O95727) SP+PP+ECD
MWWRVLSLLAWFPLQEASLTNHTETITVEEGQTLTLKCVTSLRKNSSLQWLTPSGFTIFLNEYPALKNSKYQLLHHSANQLSITVPNVTLQDEGVYKCLHYSDSVSTKEVKVIVLATPFKPILEASVIRKQNGEEHVVLMCSTMRSKPPPQITWLLGNSMEVSGGTLHEFETDGKKCNTTSTLIIHTYGKNSTVDCIIRHRGLQGRKLVAPFRFEDLVTDEETASDALERNSLSSQDPQQPTSTVSVTEDSSTSEIDKEEKEQTTQDPDLTTEANPQYLGLARKKSG

SEQ ID NO: 2245 - protein, 496 aa, synthetic construct
  REGION 1..496: note = CSF1 (P09603) SP+PP+ECD
MTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQDVVTKPDCNCLYPKAIPSSDPASVSPHQPLAPSMAPVAGLTWEDSEGTEGSSLLPGEQPLHTVDPGSAKQRPPRSTCQSFEPPETPVVKDSTIGGSPQPRPSVGAFNPGMEDILDSAMGTNWVPEEASGEASEIPVPQGTELSPSRPGGGSMQTEPARPSNFLSASSPLPASAKGQQPADVTGTALPRVGPVRPTGQDWNHTPQKTDHPSALLRDPPEPGSPRISSLRPQGLSNPSTLSAQPQLSRSHSSGSVLPLGELEGRRSTRDRRSPAEPEGGPASEGAARPLPRFNSVPLTDTGHERQSEGSFSPQLQES

SEQ ID NO: 2246 - protein, 517 aa, synthetic construct
  REGION 1..517: note = CSF1R (P07333) SP+PP+ECD
MGPGVLLLLLVATAWHGQGIPVIEPSVPELVVKPGATVTLRCVGNGSVEWDGPPSPHWTLYSDGSSSILSTNNATFQNTGTYRCTEPGDPLGGSAAIHLYVKDPARPWNVLAQEVVVFEDQDALLPCLLTDPVLEAGVSLVRVRGRPLMRHTNYSFSPWHGFTIHRAKFIQSQDYQCSALMGGRKVMSISIRLKVQKVIPGPPALTLVPAELVRIRGEAAQIVCSASSVDVNFDVFLQHNNTKLAIPQQSDFHNNRYQKVLTLNLDQVDFQHAGNYSCVASNVQGKHSTSMFFRVVESAYLNLSSEQNLIQEVTVGEGLNLKVMVEAYPGLQGFNWTYLGPFSDHQPEPKLANATTKDTYRHTFTLSLPRLKPSEAGRYSFLARNPGGWRALTFELTLRYPPEVSVIWTFINGSGTLLCAASGYPQPNVTWLQCSGHTDRCDEAQVLQVWDDPYPEVLSQEPFHKVTVQSLLTVETLEHNQTYECRAHNSVGSGSWAFIPISAGAHTHPPDEFLFTP

SEQ ID NO: 2247 - protein, 320 aa, synthetic construct
  REGION 1..320: note = CSF2RA (P15509) SP+PP+ECD
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLINVSGDLENRYNFPSSEPRAKHSVKIRAADVRILNWSSWSEAIEFGSDDG

SEQ ID NO: 2248 - protein, 443 aa, synthetic construct
  REGION 1..443: note = CSF2RB (P32927) SP+PP+ECD
MVLAQGLLSMALLALCWERSLAGAEETIPLQTLRCYNDYTSHITCRWADTQDAQRLVNVTLIRRVNEDLLEPVSCDLSDDMPWSACPHPRCVPRRCVIPCQSFVVTDVDYFSFQPDRPLGTRLTVTLTQHVQPPEPRDLQISTDQDHFLLTWSVALGSPQSHWLSPGDLEFEVVYKRLQDSWEDAAILLSNTSQATLGPEHLMPSSTYVARVRTRLAPGSRLSGRPSKWSPEVCWDSQPGDEAQPQNLECFFDGAAVLSCSWEVRKEVASSVSFGLFYKPSPDAGEEECSPVLREGLGSLHTRHHCQIPVPDPATHGQYIVSVQPRRAEKHIKSSVNIQMAPPSLNVTKDGDSYSLRWETMKMRYEHIDHTFEIQYRKDTATWKDSKTETLQNAHSMALPALEPSTRYWARVRVRTSRTGYNGIWSEWSEARSWDTESVLPMW

SEQ ID NO: 2249 - protein, 627 aa, synthetic construct
  REGION 1..627: note = CSF3R (Q99062) SP+PP+ECD
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELH

SEQ ID NO: 2250 - protein, 3487 aa, synthetic construct
  REGION 1..3487: note = CSMD1 (Q96PZ7) SP+PP+ECD
MTAWRRFQSLLLLLGLLVLCARLLTAAKGQNCGGLVQGPNGTIESPGFPHGYPNYANCTWIIITGERNRIQLSFHTFALEEDFDILSVYDGQPQQGNLKVRLSGFQLPSSIVSTGSILTLWFTTDFAVSAQGFKALYEVLPSHTCGNPGEILKGVLHGTRFNIGDKIRYSCLPGYILEGHAILTCIVSPGNGASWDFPAPFCRAEGACGGTLRGTSSSISSPHFPSEYENNADCTWTILAEPGDTIALVFTDFQLEEGYDFLEISGTEAPSIWLTGMNLPSPVISSKNWLRLHFTSDSNHRRKGFNAQFQVKKAIELKSRGVKMLPSKDGSHKNSVLSQGGVALVSDMCPDPGIPENGRRAGSDFRVGANVQFSCEDNYVLQGSKSITCQRVTETLAAWSDHRPICRARTCGSNLRGPSGVITSPNYPVQYEDNAHCVWVITTTDPDKVIKLAFEEFELERGYDTLTVGDAGKVGDTRSVLYVLTGSSVPDLIVSMSNQMWLHLQSDDSIGSPGFKAVYQEIEKGGCGDPGIPAYGKRTGSSFLHGDTLTFECPAAFELVGERVITCQQNNQWSGNKPSCVFSCFFNFTASSGIILSPNYPEEYGNNMNCVWLIISEPGSRIHLIFNDFDVEPQFDFLAVKDDGISDITVLGTFSGNEVPSQLASSGHIVRLEFQSDHSTTGRGFNITYTTFGQNECHDPGIPINGRRFGDRFLLGSSVSFHCDDGFVKTQGSESITCILQDGNVVWSSTVPRCEAPCGGHLTASSGVILPPGWPGYYKDSLHCEWIIEAKPGHSIKITFDRFQTEVNYDTLEVRDGPASSSPLIGEYHGTQAPQFLISTGNFMYLLFTTDNSRSSIGFLIHYESVTLESDSCLDPGIPVNGHRHGGDFGIRSTVTFSCDPGYTLSDDEPLVCERNHQWNHALPSCDALCGGYIQGKSGTVLSPGFPDFYPNSLNCTWTIEVSHGKGVQMIFHTFHLESSHDYLLITEDGSFSEPVARLTGSVLPHTIKAGLFGNFTAQLRFISDFSISYEGFNITFSEYDLEPCDDPGVPAFSRRIGFHFGVGDSLTFSCFLGYRLEGATKLTCLGGGRRVWSAPLPRCVAECGASVKGNEGTLLSPNFPSNYDNNHECIYKIETEAGKGIHLRTRSFQLFEGDTLKVYDGKDSSSRPLGTFTKNELLGLILNSTSNHLWLEFNTNGSDTDQGFQLTYTSFDLVKCEDPGIPNYGYRIRDEGHFTDTVVLYSCNPGYAMHGSNTLTCLSGDRRVWDKPLPSCIAECGGQIHAATSGRILSPGYPAPYDNNLHCTWIIEADPGKTISLHFIVFDTEMAHDILKVWDGPVDSDILLKEWSGSALPEDIHSTFNSLTLQFDSDFFISKSGFSIQFSTSIAATCNDPGMPQNGTRYGDSREAGDTVTFQCDPGYQLQGQAKITCVQLNNRFFWQPDPPTCIAACGGNLTGPAGVILSPNYPQPYPPGKECDWRVKVNPDFVIALIFKSFNMEPSYDFLHIYEGEDSNSPLIGSYQGSQAPERIESSGNSLFLAFRSDASVGLSGFAIEFKEKPREACFDPGNIMNGTRVGTDFKLGSTITYQCDSGYKILDPSSITCVIGADGKPSWDQVLPSCNAPCGGQYTGSEGVVLSPNYPHNYTAGQICLYSITVPKEFVVFGQFAYFQTALNDLAELFDGTHAQARLLSSLSGSHSGETLPLATSNQILLRFSAKSGASARGFHFVYQAVPRTSDTQCSSVPEPRYGRRIGSEFSAGSIVRFECNPGYLLQGSTALHCQSVPNALAQWNDTIPSCVVPCSGNFTQRRGTILSPGYPEPYGNNLNCIWKIIVTEGSGIQIQVISFATEQNWDSLEIHDGGDVTAPRLGSFSGTTVPALLNSTSNQLYLHFQSDISVAAAGFHLEYKTVGLAACQEPALPSNSIKIGDRYMVNDVLSFQCEPGYTLQGRSHISCMPGTVRRWNYPSPLCIATCGGTLSTLGGVILSPGFPGSYPNNLDCTWRISLPIGYGAHIQFLNFSTEANHDFLEIQNGPYHTSPMIGQFSGTDLPAALLSTTHETLIHFYSDHSQNRQGFKLAYQAYELQNCPDPPPFQNGYMINSDYSVGQSVSFECYPGYILIGHPVLTCQHGINRNWNYPFPRCDAPCGYNVTSQNGTIYSPGFPDEYPILKDCIWLITVPPGHGVYINFTLLQTEAVNDYIAVWDGPDQNSPQLGVFSGNTALETAYSSTNQVLLKFHSDFSNGGFFVLNFHAFQLKKCQPPPAVPQAEMLTEDDDFEIGDFVKYQCHPGYTLVGTDILTCKLSSQLQFEGSLPTCEAQCPANEVRTGSSGVILSPGYPGNYFNSQTCSWSIKVEPNYNITIFVDTFQSEKQFDALEVFDGSSGQSPLLVVLSGNHTEQSNFTSRSNQLYLRWSTDHATSKKGFKIRYAAPYCSLTHPLKNGGILNRTAGAVGSKVHYFCKPGYRMVGHSNATCRRNPLGMYQWDSLTPLCQAVSCGIPESPGNGSFTGNEFTLDSKVVYECHEGFKLESSQQATAVCQEDGLWSNKGKPPTCKPVACPSIEAQLSEHVIWRLVSGSLNEYGAQVLLSCSPGYYLEGWRLLRCQANGTWNIGDERPSCRVISCGSLSFPPNGNKIGTLTVYGATAIFTCNTGYTLVGSHVRECLANGLWSGSETRCLAGHCGSPDPIVNGHISGDGFSYRDTVVYQCNPGFRLVGTSVRICLQDHKWSGQTPVCVPITCGHPGNPAHGFTNGSEFNLNDVVNFTCNTGYLLQGVSRAQCRSNGQWSSPLPTCRVVNCSDPGFVENAIRHGQQNFPESFEYGMSILYHCKKGFYLLGSSALTCMANGLWDRSLPKCLAISCGHPGVPANAVLTGELFTYGAVVHYSCRGSESLIGNDTRVCQEDSHWSGALPHCTGNNPGFCGDPGTPAHGSRLGDDFKTKSLLRFSCEMGHQLRGSPERTCLLNGSWSGLQPVCEAVSCGNPGTPTNGMIVSSDGILFSSSVIYACWEGYKTSGLMTRHCTANGTWTGTAPDCTIISCGDPGTLANGIQFGTDFTFNKTVSYQCNPGYVMEAVTSATIRCTKDGRWNPSKPVCKAVLCPQPPPVQNGTVEGSDFRWGSSISYSCMDGYQLSHSAILSCEGRGVWKGEIPQCLPVFCGDPGIPAEGRLSGKSFTYKSEVFFQCKSPFILVGSSRRVCQADGTWSGIQPTCIDPAHNTCPDPGTPHFGIQNSSRGYEVGSTVFFRCRKGYHIQGSTTRTCLANLTWSGIQTECIPHACRQPETPAHADVRAIDLPTFGYTLVYTCHPGFFLAGGSEHRTCKADMKWTGKSPVCKSKGVREVNETVTKTPVPSDVFFVNSLWKGYYEYLGKRQPATLTVDWFNATSSKVNATFSEASPVELKLTGIYKKEEAHLLLKAFQIKGQADIFVSKFENDNWGLDGYVSSGLERGGFTFQGDIHGKDFGKFKLERQDPLNPDQDSSSHYHGTSSGS

SEQ ID NO: 2251 - protein, 2224 aa, synthetic construct
  REGION 1..2224: note = CSPG4 (Q6UVK1) SP+PP+ECD
MQSGPRPPLPAPGLALALTLTMLARLASAASFFGENHLEVPVATALTDIDLQLQFSTSQPEALLLLAAGPADHLLLQLYSGRLQVRLVLGQEELRLQTPAETLLSDSIPHTVVLTVVEGWATLSVDGFLNASSAVPGAPLEVPYGLFVGGTGTLGLPYLRGTSRPLRGCLHAATLNGRSLLRPLTPDVHEGCAEEFSASDDVALGFSGPHSLAAFPAWGTQDEGTLEFTLTTQSRQAPLAFQAGGRRGDFIYVDIFEGHLRAVVEKGQGTVLLHNSVPVADGQPHEVSVHINAHRLEISVDQYPTHTSNRGVLSYLEPRGSLLLGGLDAEASRHLQEHRLGLTPEATNASLLGCMEDLSVNGQRRGLREALLTRNMAAGCRLEEEEYEDDAYGHYEAFSTLAPEAWPAMELPEPCVPEPGLPPVFANFTQLLTISPLVVAEGGTAWLEWRHVQPTLDLMEAELRKSQVLFSVTRGARHGELELDIPGAQARKMFTLLDVVNRKARFIHDGSEDTSDQLVLEVSVTARVPMPSCLRRGQTYLLPIQVNPVNDPPHIIFPHGSLMVILEHTQKPLGPEVFQAYDPDSACEGLTFQVLGTSSGLPVERRDQPGEPATEFSCRELEAGSLVYVHRGGPAQDLTFRVSDGLQASPPATLKVVAIRPAIQIHRSTGLRLAQGSAMPILPANLSVETNAVGQDVSVLFRVTGALQFGELQKQGAGGVEGAEWWATQAFHQRDVEQGRVRYLSTDPQHHAYDTVENLALEVQVGQEILSNLSFPVTIQRATVWMLRLEPLHTQNTQQETLTTAHLEATLEEAGPSPPTFHYEVVQAPRKGNLQLQGTRLSDGQGFTQDDIQAGRVTYGATARASEAVEDTFRFRVTAPPYFSPLYTFPIHIGGDPDAPVLTNVLLVVPEGGEGVLSADHLFVKSLNSASYLYEVMERPRHGRLAWRGTQDKTTMVTSFTNEDLLRGRLVYQHDDSETTEDDIPFVATRQGESSGDMAWEEVRGVFRVAIQPVNDHAPVQTISRIFHVARGGRRLLTTDDVAFSDADSGFADAQLVLTRKDLLFGSIVAVDEPTRPIYRFTQEDLRKRRVLFVHSGADRGWIQLQVSDGQHQATALLEVQASEPYLRVANGSSLVVPQGGQGTIDTAVLHLDTNLDIRSGDEVHYHVTAGPRWGQLVRAGQPATAFSQQDLLDGAVLYSHNGSLSPRDTMAFSVEAGPVHTDATLQVTIALEGPLAPLKLVRHKKIYVFQGEAAEIRRDQLEAAQEAVPPADIVFSVKSPPSAGYLVMVSRGALADEPPSLDPVQSFSQEAVDTGRVLYLHSRPEAWSDAFSLDVASGLGAPLEGVLVELEVLPAAIPLEAQNFSVPEGGSLTLAPPLLRVSGPYFPTLLGLSLQVLEPPQHGALQKEDGPQARTLSAFSWRMVEEQLIRYVHDGSETLTDSFVLMANASEMDRQSHPVAFTVTVLPVNDQPPILTTNTGLQMWEGATAPIPAEALRSTDGDSGSEDLVYTIEQPSNGRVVLRGAPGTEVRSFTQAQLDGGLVLFSHRGTLDGGFRFRLSDGEHTSPGHFFRVTAQKQVLLSLKGSQTLTVCPGSVQPLSSQTLRASSSAGTDPQLLLYRVVRGPQLGRLFHAQQDSTGEALVNFTQAEVYAGNILYEHEMPPEPFWEAHDTLELQLSSPPARDVAATLAVAVSFEAACPQRPSHLWKNKGLWVPEGQRARITVAALDASNLLASVPSPQRSEHDVLFQVTQFPSRGQLLVSEEPLHAGQPHFLQSQLAAGQLVYAHGGGGTQQDGFHFRAHLQGPAGASVAGPQTSEAFAITVRDVNERPPQPQASVPLRLTRGSRAPISRAQLSVVDPDSAPGEIEYEVQRAPHNGFLSLVGGGLGPVTRFTQADVDSGRLAFVANGSSVAGIFQLSMSDGASPPLPMSLAVDILPSAIEVQLRAPLEVPQALGRSSLSQQQLRVVSDREEPEAAYRLIQGPQYGHLLVGGRPTSAFSQFQIDQGEVVFAFTNFSSSHDHFRVLALARGVNASAVVNVTVRALLHVWAGGPWPQGATLRLDPTVLDAGELANRTGSVPRFRLLEGPRHGRVVRVPRARTEPGGSQLVEQFTQQDLEDGRLGLEVGRPEGRAPGPAGDSLTLELWAQGVPPAVASLDFATEPYNAARPYSVALLSVPEAARTEAGKPESSTPTGEPGPMASSPEPAVAKGGFLSFLEANMFS

SEQ ID NO: 2252 - protein, 423 aa, synthetic construct
  REGION 1..423: note = CSPG5 (O95196) SP+PP+ECD
MGRAGGGGPGRGPPPLLLFLGAALVLASGAVPAREAGSAVEAEELVKGSPAWEPPANDTREEAGPPAAGEDEASWTAPGGELAGPEEVLQESAAVTGTAWLEADSPGLGGVTAEAGSGDAQALPATLQAPHEVLGQSIMPPAIPEATEASGPPSPTPGDKLSPASELPKESPLEVWLNLGGSTPDPQGPELTYPFQGTLEPQPASDIIDIDYFEGLDGEGRGADLGSFPGSPGTSENHPDTEGETPSWSLLDLYDDFTPFDESDFYPTTSFYDDLDEEEEEEEDDKDAVGGGDLEDENELLVPTGKPGLGPGTGQPTSRWHAVPPQHTLGSVPGSSIALRPRPGEPGRDLASSENGTECRSGFVRHNGSCRSVCDLFPSYCHNGGQCYLVENIGAFCRCNTQDYIWHKGMRCESIITDFQVMC

SEQ ID NO: 2253 - protein, 161 aa, synthetic construct
  REGION 1..161: note = CTLA4 (P16410) SP+PP+ECD
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSD

SEQ ID NO: 2254 - protein, 568 aa, synthetic construct
  REGION 1..568: note = CUZD1 (Q86UP6) SP+PP+ECD
MELVRRLMPLTLLILSCLAELTMAEAEGNASCTVSLGGANMAETHKAMILQLNPSENCTWTIERPENKSIRIIFSYVQLDPDGSCESENIKVFDGTSSNGPLLGQVCSKNDYVPVFESSSSTLTFQIVTDSARIQRTVFVFYYFFSPNISIPNCGGYLDTLEGSFTSPNYPKPHPELAYCVWHIQVEKDYKIKLNFKEIFLEIDKQCKFDFLAIYDGPSTNSGLIGQVCGRVTPTFESSSNSLTVVLSTDYANSYRGFSASYTSIYAENINTTSLTCSSDRMRVIISKSYLEAFNSNGNNLQLKDPTCRPKLSNVVEFSVPLNGCGTIRKVEDQSITYTNIITFSASSTSEVITRQKQLQIIVKCEMGHNSTVEIIYITEDDVIQSQNALGKYNTSMALFESNSFEKTILESPYYVDLNQTLFVQVSLHTSDPNLVVFLDTCRASPTSDFASPTYDLIKSGCSRDETCKVYPLFGHYGRFQFNAFKFLRSMSSVYLQCKVLICDSSDHQSRCNQGCVSRSKRDISSYKWKTDSIIGPIRLKRDRSASGNSGFQHETHAEETPNQPFNS

SEQ ID NO: 2255 - protein, 341 aa, synthetic construct
  REGION 1..341: note = CX3CL1 (P78423) SP+PP+ECD
MAPISLSWLLRLATFCHLTVLLAGQHHGVTKCNITCSKMTSKIPVALLIHYQQNQASCGKRAIILETRQHRLFCADPKEQWVKDAMQHLDRQAAALTRNGGTFEKQIGEVKPRTTPAAGGMDESVVLEPEATGESSSLEPTPSSQEAQRALGTSPELPTGVTGSSGTRLPPTPKAQDGGPVGTELFRVPPVSTAATWQSSAPHQPGPSLWAEAKTSEAPSTQDPSTQASTASSPAPEENAPSEGQRVWGQGQSPRPENSLEREEMGPVPAHTDAFQDWGPGSMAHVSVVPVSSEGTPSREPVASGSWTPKAEEPIHATMDPQRLGVLITPVPDAQAATRRQ

SEQ ID NO: 2256 - protein, 237 aa, synthetic construct
  REGION 1..237: note = CXADR (P78310) SP+PP+ECD
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEMTSSVISVKNASSEYSGTYSCTVRNRVGSDQCLLRLNVVPPSNKAG

SEQ ID NO: 2257 - protein, 205 aa, synthetic construct
  REGION 1..205: note = CXCL16 (Q9H2A7) SP+PP+ECD
MGRDLRPGSRVLLLLLLLLLVYLTQPGNGNEGSVTGSCYCGKRISSDSPPSVQFMNRLRKHLRAYHRCLYYTRFQLLSWSVCGGNKDPWVQELMSCLDLKECGHAYSGIVAHQKHLLPTSPPISQASEGASSDIHTPAQMLLSTLQSTQRPTLPVGSLSSDKELTRPNETTIHTAGHSLAAGPEAGENQKQPEKNAGPTARTSAT

SEQ ID NO: 2258 - protein, 749 aa, synthetic construct
  REGION 1..749: note = DAG1 (Q14118) SP+PP+ECD
MRMSVGLSLLLPLSGRTFLLLLSVVMAQSHWPSEPSEAVRDWENQLEASMHSVLSDLHEAVPTVVGIPDGTAVVGRSFRVTIPTDLIASSGDIIKVSAAGKEALPSWLHWDSQSHTLEGLPLDTDKGVHYISVSATRLGANGSHIPQTSSVFSIEVYPEDHSELQSVRTASPDPGEVVSSACAADEPVTVLTVILDADLTKMTPKQRIDLLHRMRSFSEVELHNMKLVPVVNNRLFDMSAFMAGPGNAKKVVENGALLSWKLGCSLNQNSVPDIHGVEAPAREGAMSAQLGYPVVGWHIANKKPPLPKRVRRQIHATPTPVTAIGPPTTAIQEPPSRIVPTPTSPAIAPPTETMAPPVRDPVPGKPTVTIRTRGAIIQTPTLGPIQPTRVSEAGTTVPGQIRPTMTIPGYVEPTAVATPPTTTTKKPRVSTPKPATPSTDSTTTTTRRPTKKPRTPRPVPRVTTKVSITRLETASPPTRIRTTTSGVPRGGEPNQRPELKNHIDRVDAWVGTYFEVKIPSDTFYDHEDTTTDKLKLTLKLREQQLVGEKSWVQFNSNSQLMYGLPDSSHVGKHEYFMHATDKGGLSAVDAFEIHVHRRPQGDRAPARFKAKFVGDPALVLNDIHKKIALVKKLAFAFGDRNCSTITLQNITRGSIVVEWTNNTLPLEPCPKEQIAGLSRRIAEDDGKPRPAFSNALEPDFKATSITVTGSGSCRHLQFIPVVPPRRVPSEAPPTEVPDRDPEKSSEDDV

SEQ ID NO: 2259 - protein, 459 aa, synthetic construct
  REGION 1..459: note = DCBLD1 (Q8N8Z6) SP+PP+ECD
MVPGARGGGALARAAGRGLLALLLAVSAPLRLQAEELGDGCGHLVTYQDSGTMTSKNYPGTYPNHTVCEKTITVPKGKRLILRLGDLDIESQTCASDYLLFTSSSDQYGPYCGSMTVPKELLLNTSEVTVRFESGSHISGRGFLLTYASSDHPDLITCLERASHYLKTEYSKFCPAGCRDVAGDISGNMVDGYRDTSLLCKAAIHAGIIADELGGQISVLQRKGISRYEGILANGVLSRDGSLSDKRFLFTSNGCSRSLSFEPDGQIRASSSWQSVNESGDQVHWSPGQARLQDQGPSWASGDSSNNHKPREWLEIDLGEKKKITGIRTTGSTQSNFNFYVKSFVMNFKNNNSKWKTYKGIVNNEEKVFQGNSNFRDPVQNNFIPPIVARYVRVVPQTWHQRIALKVELIGCQITQGNDSLVWRKTSQSTSVSTKKEDETITRPIPSEETSTGINITTV

SEQ ID NO: 2260 - protein, 528 aa, synthetic construct
  REGION 1..528: note = DCBLD2 (Q96PD2) SP+PP+ECD
MASRAVVRARRCPQCPQVRAAAAAPAWAALPLSRSLPPCSNSSSFSMPLFLLLLLVLLLLLEDAGAQQGDGCGHTVLGPESGTLTSINYPQTYPNSTVCEWEIRVKMGERVRIKFGDFDIEDSDSCHFNYLRIYNGIGVSRTEIGKYCGLGLQMNHSIESKGNEITLLFMSGIHVSGRGFLASYSVIDKQDLITCLDTASNFLEPEFSKYCPAGCLLPFAEISGTIPHGYRDSSPLCMAGVHAGVVSNTLGGQISVVISKGIPYYESSLANNVTSVVGHLSTSLFTFKTSGCYGTLGMESGVIADPQITASSVLEWTDHTGQENSWKPKKARLKKPGPPWAAFATDEYQWLQIDLNKEKKITGIITTGSTMVEHNYYVSAYRILYSDDGQKWTVYREPGVEQDKIFQGNKDYHQDVRNNFLPPIIARFIRVNPTQWQQKIAMKMELLGCQFIPKGRPPKLTQPPPPRNSNDLKNTTAPPKIAKGRAPKFTQPLQPRSSNEFPAQTEQTTASPDIRNTTVTPNVTKDVA

SEQ ID NO: 2261 - protein, 1097 aa, synthetic construct
  REGION 1..1097: note = DCC (P43146) SP+PP+ECD
MENSLRCVWVPKLAFVLFGASLFSAHLQVTGFQIKAFTALRFLSEPSDAVTMRGGNVLLDCSAESDRGVPVIKWKKDGIHLALGMDERKQQLSNGSLLIQNILHSRHHKPDEGLYQCEASLGDSGSIISRTAKVAVAGPLRFLSQTESVTAFMGDTVLLKCEVIGEPMPTIHWQKNQQDLTPIPGDSRVVVLPSGALQISRLQPGDIGIYRCSARNPASSRTGNEAEVRILSDPGLHRQLYFLQRPSNVVAIEGKDAVLECCVSGYPPPSFTWLRGEEVIQLRSKKYSLLGGSNLLISNVTDDDSGMYTCVVTYKNENISASAELTVLVPPWFLNHPSNLYAYESMDIEFECTVSGKPVPTVNWMKNGDVVIPSDYFQIVGGSNLRILGVVKSDEGFYQCVAENEAGNAQTSAQLIVPKPAIPSSSVLPSAPRDVVPVLVSSRFVRLSWRPPAEAKGNIQTFTVFFSREGDNRERALNTTQPGSLQLTVGNLKPEAMYTFRVVAYNEWGPGESSQPIKVATQPELQVPGPVENLQAVSTSPTSILITWEPPAYANGPVQGYRLFCTEVSTGKEQNIEVDGLSYKLEGLKKFTEYSLRFLAYNRYGPGVSTDDITVVTLSDVPSAPPQNVSLEVVNSRSIKVSWLPPPSGTQNGFITGYKIRHRKTTRRGEMETLEPNNLWYLFTGLEKGSQYSFQVSAMTVNGTGPPSNWYTAETPENDLDESQVPDQPSSLHVRPQTNCIIMSWTPPLNPNIVVRGYIIGYGVGSPYAETVRVDSKQRYYSIERLESSSHYVISLKAFNNAGEGVPLYESATTRSITDPTDPVDYYPLLDDFPTSVPDLSTPMLPPVGVQAVALTHDAVRVSWADNSVPKNQKTSEVRLYTVRWRTSFSASAKYKSEDTTSLSYTATGLKPNTMYEFSVMVTKNRRSSTWSMTAHATTYEAAPTSAPKDLTVITREGKPRAVIVSWQPPLEANGKITAYILFYTLDKNIPIDDWIMETISGDRLTHQIMDLNLDTMYYFRIQARNSKGVGPLSDPILFRTLKVEHPDKMANDQGRHGDGGYWPVDTNLIDRSTLNEPPIGQMHPPHGSVTPQKNSN

SEQ ID NO: 2262 - protein, 2940 aa, synthetic construct
  REGION 1..2940: note = DCHS1 (Q96JQ0) SP+PP+ECD
MQKELGIVPSCPGMKSPRPHLLLPLLLLLLLLLGAGVPGAWGQAGSLDLQIDEEQPAGTLIGDISAGLPAGTAAPLMYFISAQEGSGVGTDLAIDEHSGVVRTARVLDREQRDRYRFTAVTPDGATVEVTVRVADINDHAPAFPQARAALQVPEHTAFGTRYPLEPARDADAGRLGTQGYALSGDGAGETFRLETRPGPDGTPVPELVVTGELDRENRSHYMLQLEAYDGGSPPRRAQALLDVTLLDINDHAPAFNQSRYHAVVSESLAPGSPVLQVFASDADAGVNGAVTYEINRRQSEGDGPFSIDAHTGLLQLERPLDFEQRRVHELVVQARDGGAHPELGSAFVTVHVRDANDNQPSMTVIFLSADGSPQVSEAAPPGQLVARISVSDPDDGDFAHVNVSLEGGEGHFALSTQDSVIYLVCVARRLDREERDAYNLRVTATDSGSPPLRAEAAFVLHVTDVNDNAPAFDRQLYRPEPLPEVALPGSFVVRVTARDPDQGTNGQVTYSLAPGAHTHWFSIDPTSGIITTAASLDYELEPQPQLIVVATDGGLPPLASSATVSVALQDVNDNEPQFQRTFYNASLPEGTQPGTCFLQVTATDADSGPFGLLSYSLGAGLGSSGSPPFRIDAHSGDVCTTRTLDRDQGPSSFDFTVTAVDGGGLKSMVYVKVFLSDENDNPPQFYPREYAASISAQSPPGTAVLRLRAHDPDQGSHGRLSYHILAGNSPPLFTLDEQSGLLTVAWPLARRANSVVQLEIGAEDGGGLQAEPSARVDISIVPGTPTPPIFEQLQYVFSVPEDVAPGTSVGIVQAHNPPGRLAPVTLSLSGGDPRGLFSLDAVSGLLQTLRPLDRELLGPVLELEVRAGSGVPPAFAVARVRVLLDDVNDNSPAFPAPEDTVLLPPNTAPGTPIYTLRALDPDSGVNSRVTFTLLAGGGGAFTVDPTTGHVRLMRPLGPSGGPAHELELEARDGGSPPRTSHFRLRVVVQDVGTRGLAPRFNSPTYRVDLPSGTTAGTQVLQVQAQAPDGGPITYHLAAEGASSPFGLEPQSGWLWVRAALDREAQELYILKVMAVSGSKAELGQQTGTATVRVSILNQNEHSPRLSEDPTFLAVAENQPPGTSVGRVFATDRDSGPNGRLTYSLQQLSEDSKAFRIHPQTGEVTTLQTLDREQQSSYQLLVQVQDGGSPPRSTTGTVHVAVLDLNDNSPTFLQASGAAGGGLPIQVPDRVPPGTLVTTLQAKDPDEGENGTILYTLTGPGSELFSLHPHSGELLTAAPLIRAERPHYVLTLSAHDQGSPPRSASLQLLVQVLPSARLAEPPPDLAERDPAAPVPVVLTVTAAEGLRPGSLLGSVAAPEPAGVGALTYTLVGGADPEGTFALDAASGRLYLARPLDFEAGPPWRALTVRAEGPGGAGARLLRVQVQVQDENEHAPAFARDPLALALPENPEPGAALYTFRASDADGPGPNSDVRYRLLRQEPPVPALRLDARTGALSAPRGLDRETTPALLLLVEATDRPANASRRRAARVSARVFVTDENDNAPVFASPSRVRLPEDQPPGPAALHVVARDPDLGEAARVSYRLASGGDGHFRLHSSTGALSVVRPLDREQRAEHVLTVVASDHGSPPRSATQVLTVSVADVNDEAPTFQQQEYSVLLRENNPPGTSLLTLRATDPDVGANGQVTYGGVSSESFSLDPDTGVLTTLRALDREEQEEINLTVYAQDRGSPPQLTHVTVRVAVEDENDHAPTFGSAHLSLEVPEGQDPQTLTMLRASDPDVGANGQLQYRILDGDPSGAFVLDLASGEFGTMRPLDREVEPAFQLRIEARDGGQPALSATLLLTVTVLDANDHAPAFPVPAYSVEVPEDVPAGTLLLQLQAHDPDAGANGHVTYYLGAGTAGAFLLEPSSGELRTAAALDREQCPSYTFSVSAVDGAAAGPLSTTVSVTITVRDVNDHAPTFPTSPLRLRLPRPGPSFSTPTLALATLRAEDRDAGANASILYRLAGTPPPGTTVDSYTGEIRVARSPVALGPRDRVLFIVATDLGRPARSATGVIIVGLQGEAERGPRFPRASSEATIRENAPPGTPIVSPRAVHAGGTNGPITYSILSGNEKGTFSIQPSTGAITVRSAEGLDFEVSPRLRLVLQAESGGAFAFTVLTLTLQDANDNAPRFLRPHYVAFLPESRPLEGPLLQVEADDLDQGSGGQISYSLAASQPARGLFHVDPTTGTITTTAILDREIWAETRLVLMATDRGSPALVGSATLTVMVIDTNDNRPTIPQPWELRVSEDALLGSEIAQVTGNDVDSGPVLWYVLSPSGPQDPFSVGRYGGRVSLTGPLDFEQCDRYQLQLLAHDGPHEGRANLTVLVEDVNDNAPAFSQSLYQVMLLEHTPPGSAILSVSATDRDSGANGHISYHLASPADGFSVDPNNGTLFTIVGTVALGHDGSGAVDVVLEARDHGAPGRAARATVHVQLQDQNDHAPSFTLSHYRVAVTEDLPPGSTLLTLEATDADGSRSHAAVDYSIISGNWGRVFQLEPRLAEAGESAGPGPRALGCLVLLEPLDFESLTQYNLTVAAADRGQPPQSSVVPVTVTVLDVNDNPPVFTRASYRVTVPEDTPVGAELLHVEASDADPGPHGLVRFTVSSGDPSGLFELDESSGTLRLAHALDCETQARHQLVVQAADPAGAHFALAPVTIEVQDVNDHGPAFPLNLLSTSVAENQPPGTLVTTLHAIDGDAGAFGRLRYSLLEAGPGPEGREAFALNSSTGELRARVPFDYEHTESFRLLVGAADAGNLSASVTVSVLVTGEDEYDPVFLAPAFHFQVPEGARRGHSLGHVQATDEDGGADGLVLYSLATSSPYFGINQTTGALYLRVDSRAPGSGTATSGGGGRTRREAPRELRLEVIARGPLPGSRSATVPVTVDITHTALGLAPDLNLLLVGA

SEQ ID NO: 2263 - protein, 472 aa, synthetic construct
  REGION 1..472: note = DCT (P40126) SP+PP+ECD
MSPLWWGFLLSCLGCKILPGAQGQFPRVCMTVDSLVNKECCPRLGAESANVCGSQQGRGQCTEVRADTRPWSGPYILRNQDDRELWPRKFFHRTCKCTGNFAGYNCGDCKFGWTGPNCERKKPPVIRQNIHSLSPQEREQFLGALDLAKKRVHPDYVITTQHWLGLLGPNGTQPQFANCSVYDFFVWLHYYSVRDTLLGPGRPYRAIDFSHQGPAFVTWHRYHLLCLERDLQRLIGNESFALPYWNFATGRNECDVCTDQLFGAARPDDPTLISRNSRFSSWETVCDSLDDYNHLVTLCNGTYEGLLRRNQMGRNSMKLPTLKDIRDCLSLQKFDNPPFFQNSTFSFRNALEGFDKADGTLDSQVMSLHNLVHSFLNGTNALPHSAANDPIFVVLHSFTDAIFDEWMKRFNPPADAWPQELAPIGHNRMYNMVPFFPPVTNEELFLTSDQLGYSYAIDLPVSVEETPGWPTT

SEQ ID NO: 2264 - protein, 417 aa, synthetic construct
  REGION 1..417: note = DDR1 (Q08345) SP+PP+ECD
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTA

SEQ ID NO: 2265 - protein, 399 aa, synthetic construct
  REGION 1..399: note = DDR2 (Q16832) SP+PP+ECD
MILIPRMLLVLFLLLPILSSAKAQVNPAICRYPLGMSGGQIPDEDITASSQWSESTAAKYGRLDSEEGDGAWCPEIPVEPDDLKEFLQIDLHTLHFITLVGTQGRHAGGHGIEFAPMYKINYSRDGTRWISWRNRHGKQVLDGNSNPYDIFLKDLEPPIVARFVRFIPVTDHSMNVCMRVELYGCVWLDGLVSYNAPAGQQFVLPGGSIIYLNDSVYDGAVGYSMTEGLGQLTDGVSGLDDFTQTHEYHVWPGYDYVGWRNESATNGYIEIMFEFDRIRNFTTMKVHCNNMFAKGVKIFKEVQCYFRSEASEWEPNAISFPLVLDDVNPSARFVTVPLHHRMASAIKCQYHFADTWMMFSEITFQSDAAMYNNSEALPTSPMAPTTYDPMLKVDDSNTR

SEQ ID NO: 2266 - protein, 349 aa, synthetic construct
  REGION 1..349: note = DGCR2 (P98153) SP+PP+ECD
MVPKADSGAFLLLFLLVLTVTEPLRPELRCNPGQFACRSGTIQCIPLPWQCDGWATCEDESDEANCPEVTGEVRPHHGKEAVDPRQGRARGGDPSHFHAVNVAQPVRFSSFLGKCPTGWHHYEGTASCYRVYLSGENYWDAAQTCQRLNGSLATFSTDQELRFVLAQEWDQPERSFGWKDQRKLWVGYQYVITGRNRSLEGRWEVAFKGSSEVFLPPDPIFASAMSENDNVFCAQLQCFHFPTLRHHDLHSWHAESCYEKSSFLCKRSQTCVDIKDNVVDEGFYFTPKGDDPCLSCTCHGGEPEMCVAALCERPQGCQQYRKDPKECCKFMCLDPDGNSLFDSMASGMR

SEQ ID NO: 2267 - protein, 303 aa, synthetic construct
  REGION 1..303: note = DLK1 (P80370) SP+PP+ECD
MTATEALLRVLLLLLAFGHSTYGAECFPACNPQNGFCEDDNVCRCQPGWQGPLCDQCVTSPGCLHGLCGEPGQCICTDGWDGELCDRDVRACSSAPCANNRTCVSLDDGLYECSCAPGYSGKDCQKKDGPCVINGSPCQHGGTCVDDEGRASHASCLCPPGFSGNFCEIVANSCTPNPCENDGVCTDIGGDFRCRCPAGFIDKTCSRPVTNCASSPCQNGGTCLQHTQVSYECLCKPEFTGLTCVKKRALSPQQVTRLPSGYGLAYRLTPGVHELPVQQPEHRILKVSMKELNKKTPLLTEGQ

SEQ ID NO: 2268 - protein, 306 aa, synthetic construct
  REGION 1..306: note = DLK2 (Q6UY11) SP+PP+ECD
MPSGCRCLHLVCLLCILGAPGQPVRADDCSSHCDLAHGCCAPDGSCRCDPGWEGLHCERCVRMPGCQHGTCHQPWQCICHSGWAGKFCDKDEHICTTQSPCQNGGQCMYDGGGEYHCVCLPGFHGRDCERKAGPCEQAGSPCRNGGQCQDDQGFALNFTCRCLVGFVGARCEVNVDDCLMRPCANGATCLDGINRFSCLCPEGFAGRFCTINLDDCASRPCQRGARCRDRVHDFDCLCPSGYGGKTCELVLPVPDPPTTVDTPLGPTSAVVVPATGPAPHSAGAGLLRISVKEVVRRQEAGLGEPS

SEQ ID NO: 2269 - protein, 545 aa, synthetic construct
  REGION 1..545: note = DLL1 (O00548) SP+PP+ECD
MGSRCALALAVLSALLCQVWSSGVFELKLQEFVNKKGLLGNRNCCRGGAGPPPCACRTFFRVCLKHYQASVSPEPPCTYGSAVTPVLGVDSFSLPDGGGADSAFSNPIRFPFGFTWPGTFSLIIEALHTDSPDDLATENPERLISRLATQRHLTVGEEWSQDLHSSGRTDLKYSYRFVCDEHYYGEGCSVFCRPRDDAFGHFTCGERGEKVCNPGWKGPYCTEPICLPGCDEQHGFCDKPGECKCRVGWQGRYCDECIRYPGCLHGTCQQPWQCNCQEGWGGLFCNQDLNYCTHHKPCKNGATCTNTGQGSYTCSCRPGYTGATCELGIDECDPSPCKNGGSCTDLENSYSCTCPPGFYGKICELSAMTCADGPCFNGGRCSDSPDGGYSCRCPVGYSGFNCEKKIDYCSSSPCSNGAKCVDLGDAYLCRCQAGFSGRHCDDNVDDCASSPCANGGTCRDGVNDFSCTCPPGYTGRNCSAPVSRCEHAPCHNGATCHERGHRYVCECARGYGGPNCQFLLPELPPGPAVVDLTEKLEGQGGPFPW

SEQ ID NO: 2270 - protein, 492 aa, synthetic construct
  REGION 1..492: note = DLL3 (Q9NYJ7) SP+PP+ECD
MVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYL

SEQ ID NO: 2271 - protein, 529 aa, synthetic construct
  REGION 1..529: note = DLL4 (Q9NR61) SP+PP+ECD
MAAASRSASGWALLLLVALWQQRAAGSGVFQLQLQEFINERGVLASGRPCEPGCRTFFRVCLKHFQAVVSPGPCTFGTVSTPVLGTNSFAVRDDSSGGGRNPLQLPFNFTWPGTFSLIIEAWHAPGDDLRPEALPPDALISKIAIQGSLAVGQNWLLDEQTSTLTRLRYSYRVICSDNYYGDNCSRLCKKRNDHFGHYVCQPDGNLSCLPGWTGEYCQQPICLSGCHEQNGYCSKPAECLCRPGWQGRLCNECIPHNGCRHGTCSTPWQCTCDEGWGGLFCDQDLNYCTHHSPCKNGATCSNSGQRSYTCTCRPGYTGVDCELELSECDSNPCRNGGSCKDQEDGYHCLCPPGYYGLHCEHSTLSCADSPCFNGGSCRERNQGANYACECPPNFTGSNCEKKVDRCTSNPCANGGQCLNRGPSRMCRCRPGFTGTYCELHVSDCARNPCAHGGTCHDLENGLMCTCPAGFSGRRCEVRTSIDACASSPCFNRATCYTDLSTDTFVCNCPYGFVGSRCEFPVGLPPSFPW

SEQ ID NO: 2272 - protein, 640 aa, synthetic construct
  REGION 1..640: note = DNER (Q8NFT8) SP+PP+ECD
MQPRRAQAPGAQLLPALALLLLLLGAGPRGSSLANPVPAAPLSAPGPCAAQPCRNGGVCTSRPEPDPQHPAPAGEPGYSCTCPAGISGANCQLVADPCASNPCHHGNCSSSSSSSSDGYLCICNEGYEGPNCEQALPSLPATGWTESMAPRQLQPVPATQEPDKILPRSQATVTLPTWQPKTGQKVVEMKWDQVEVIPDIACGNASSNSSAGGRLVSFEVPQNTSVKIRQDATASLILLWKVTATGFQQCSLIDGRSVTPLQASGGLVLLEEMLALGNNHFIGFVNDSVTKSIVALRLTLVVKVSTCVPGESHANDLECSGKGKCTTKPSEATFSCTCEEQYVGTFCEEYDACQRKPCQNNASCIDANEKQDGSNFTCVCLPGYTGELCQSKIDYCILDPCRNGATCISSLSGFTCQCPEGYFGSACEEKVDPCASSPCQNNGTCYVDGVHFTCNCSPGFTGPTCAQLIDFCALSPCAHGTCRSVGTSYKCLCDPGYHGLYCEEEYNECLSAPCLNAATCRDLVNGYECVCLAEYKGTHCELYKDPCANVSCLNGATCDSDGLNGTCICAPGFTGEECDIDINECDSNPCHHGGSCLDQPNGYNCHCPHGWVGANCEIHLQWKSGHMAESLTNMPRHSLY

SEQ ID NO: 2273 - protein, 448 aa, synthetic construct
  REGION 1..448: note = DPCR1 (Q3MIW9) SP+PP+ECD
MAQPVHSLCSAFGLQCCLLFLLASWGAGATTFQEYQKTGELSTSDHIFPLTPGLVYSIPFDHIVLHSGQRPPELPKSTEIHEQKRHCNTTRHSKPTDKPTGNSKTIDHKSSTDNHEAPPTSEENSSNQGKDPMIRNQRSVDPADSTTTHKESAGKKHITPAPKSKINCRKSTTGKSTVTRKSDKTGRPLEKSMSTLDKTSTSSHKTTTSFHNSGNSQTKQKSTSFPEKITAASKTTYKTTGTPEESEKTEDSRTTVASDKLLTKTTKNIQETISANELTQSLAEPTEHGGRTANENNTPSPAEPTENRERTANENKKTICTKGKNTPVPEKPTENLGNTTLTTETIKAPVKSTENPEKTAAVTKTIKPSVKVTGDKSLTTTSSHLNKTEVTHQVPTGSFTLITSRTKLSSITSEATGNESHPYLNKDGSQKGIHAGQMGENDSFPAWA

SEQ ID NO: 2274 - protein, 691 aa, synthetic construct
  REGION 1..691: note = DSC1 (Q08554) SP+PP+ECD
MALASAAPGSIFCKQLLFSLLVLTLLCDACQKVYLRVPSHLQAETLVGKVNLEECLKSASLIRSSDPAFRILEDGSIYTTHDLILSSERKSFSIFLSDGQRREQQEIKVVLSARENKSPKKRHTKDTALKRSKRRWAPIPASLMENSLGPFPQHVQQIQSDAAQNYTIFYSISGPGVDKEPFNLFYIEKDTGDIFCTRSIDREKYEQFALYGYATTADGYAPEYPLPLIIKIEDDNDNAPYFEHRVTIFTVPENCRSGTSVGKVTATDLDEPDTLHTRLKYKILQQIPDHPKHFSIHPDTGVITTTTPFLDREKCDTYQLIMEVRDMGGQPFGLFNTGTITISLEDENDNPPSFTETSYVTEVEENRIDVEILRMKVQDQDLPNTPHSKAVYKILQGNENGNFIISTDPNTNEGVLCVVKPLNYEVNRQVILQVGVINEAQFSKAASSQTPTMCTTTVTVKIIDSDEGPECHPPVKVIQSQDGFPAGQELLGYKALDPEISSGEGLRYQKLGDEDNWFEINQHTGDLRTLKVLDRESKFVKNNQYNISVVAVDAVGRSCTGTLVVHLDDYNDHAPQIDKEVTICQNNEDFAVLKPVDPDGPENGPPFQFFLDNSASKNWNIEEKDGKTAILRQRQNLDYNYYSVPIQIKDRHGLVATHMLTVRVCDCSTPSECRMKDKSTRDVRPNVILGR

SEQ ID NO: 2275 - protein, 694 aa, synthetic construct
  REGION 1..694: note = DSC2 (Q02487) SP+PP+ECD
MEAARPSGSWNGALCRLLLLTLAILIFASDACKNVTLHVPSKLDAEKLVGRVNLKECFTAANLIHSSDPDFQILEDGSVYTTNTILLSSEKRSFTILLSNTENQEKKKIFVFLEHQTKVLKKRHTKEKVLRRAKRRWAPIPCSMLENSLGPFPLFLQQVQSDTAQNYTIYYSIRGPGVDQEPRNLFYVERDTGNLYCTRPVDREQYESFEIIAFATTPDGYTPELPLPLIIKIEDENDNYPIFTEETYTFTIFENCRVGTTVGQVCATDKDEPDTMHTRLKYSIIGQVPPSPTLFSMHPTTGVITTTSSQLDRELIDKYQLKIKVQDMDGQYFGLQTTSTCIINIDDVNDHLPTFTRTSYVTSVEENTVDVEILRVTVEDKDLVNTANWRANYTILKGNENGNFKIVTDAKTNEGVLCVVKPLNYEEKQQMILQIGVVNEAPFSREASPRSAMSTATVTVNVEDQDEGPECNPPIQTVRMKENAEVGTTSNGYKAYDPETRSSSGIRYKKLTDPTGWVTIDENTGSIKVFRSLDREAETIKNGIYNITVLASDQGGRTCTGTLGIILQDVNDNSPFIPKKTVIICKPTMSSAEIVAVDPDEPIHGPPFDFSLESSTSEVQRMWRLKAINDTAARLSYQNDPPFGSYVVPITVRDRLGMSSVTSLDVTLCDCITENDCTHRVDPRIGGGGVQLGK

SEQ ID NO: 2276 - protein, 690 aa, synthetic construct
  REGION 1..690: note = DSC3 (Q14574) SP+PP+ECD
MAAAGPRRSVRGAVCLHLLLTLVIFSRAGEACKKVILNVPSKLEADKIIGRVNLEECFRSADLIRSSDPDFRVLNDGSVYTARAVALSDKKRSFTIWLSDKRKQTQKEVTVLLEHQKKVSKTRHTRETVLRRAKRRWAPIPCSMQENSLGPFPLFLQQVESDAAQNYTVFYSISGRGVDKEPLNLFYIERDTGNLFCTRPVDREEYDVFDLIAYASTADGYSADLPLPLPIRVEDENDNHPVFTEAIYNFEVLESSRPGTTVGVVCATDRDEPDTMHTRLKYSILQQTPRSPGLFSVHPSTGVITTVSHYLDREVVDKYSLIMKVQDMDGQFFGLIGTSTCIITVTDSNDNAPTFRQNAYEAFVEENAFNVEILRIPIEDKDLINTANWRVNFTILKGNENGHFKISTDKETNEGVLSVVKPLNYEENRQVNLEIGVNNEAPFARDIPRVTALNRALVTVHVRDLDEGPECTPAAQYVRIKENLAVGSKINGYKAYDPENRNGNGLRYKKLHDPKGWITIDEISGSIITSKILDREVETPKNELYNITVLAIDKDDRSCTGTLAVNIEDVNDNPPEILQEYVVICKPKMGYTDILAVDPDEPVHGAPFYFSLPNTSPEISRLWSLTKVNDTAARLSYQKNAGFQEYTIPITVKDRAGQAATKLLRVNLCECTHPTQCRATSRSTGVILGK

SEQ ID NO: 2277 - protein, 1595 aa, synthetic construct
  REGION 1..1595: note = DSCAM (O60469) SP+PP+ECD
MWILALSLFQSFANVFSEDLHSSLYFVNASLQEVVFASTTGTLVPCPAAGIPPVTLRWYLATGEEIYDVPGIRHVHPNGTLQIFPFPPSSFSTLIHDNTYYCTAENPSGKIRSQDVHIKAVLREPYTVRVEDQKTMRGNVAVFKCIIPSSVEAYITVVSWEKDTVSLVSGSRFLITSTGALYIKDVQNEDGLYNYRCITRHRYTGETRQSNSARLFVSDPANSAPSILDGFDHRKAMAGQRVELPCKALGHPEPDYRWLKDNMPLELSGRFQKTVTGLLIENIRPSDSGSYVCEVSNRYGTAKVIGRLYVKQPLKATISPRKVKSSVGSQVSLSCSVTGTEDQELSWYRNGEILNPGKNVRITGINHENLIMDHMVKSDGGAYQCFVRKDKLSAQDYVQVVLEDGTPKIISAFSEKVVSPAEPVSLMCNVKGTPLPTITWTLDDDPILKGGSHRISQMITSEGNVVSYLNISSSQVRDGGVYRCTANNSAGVVLYQARINVRGPASIRPMKNITAIAGRDTYIHCRVIGYPYYSIKWYKNSNLLPFNHRQVAFENNGTLKLSDVQKEVDEGEYTCNVLVQPQLSTSQSVHVTVKVPPFIQPFEFPRFSIGQRVFIPCVVVSGDLPITITWQKDGRPIPGSLGVTIDNIDFTSSLRISNLSLMHNGNYTCIARNEAAAVEHQSQLIVRVPPKFVVQPRDQDGIYGKAVILNCSAEGYPVPTIVWKFSKGAGVPQFQPIALNGRIQVLSNGSLLIKHVVEEDSGYYLCKVSNDVGADVSKSMYLTVKIPAMITSYPNTTLATQGQKKEMSCTAHGEKPIIVRWEKEDRIINPEMARYLVSTKEVGEEVISTLQILPTVREDSGFFSCHAINSYGEDRGIIQLTVQEPPDPPEIEIKDVKARTITLRWTMGFDGNSPITGYDIECKNKSDSWDSAQRTKDVSPQLNSATIIDIHPSSTYSIRMYAKNRIGKSEPSNELTITADEAAPDGPPQEVHLEPISSQSIRVTWKAPKKHLQNGIIRGYQIGYREYSTGGNFQFNIISVDTSGDSEVYTLDNLNKFTQYGLVVQACNRAGTGPSSQEIITTTLEDVPSYPPENVQAIATSPESISISWSTLSKEALNGILQGFRVIYWANLMDGELGEIKNITTTQPSLELDGLEKYTNYSIQVLAFTRAGDGVRSEQIFTRTKEDVPGPPAGVKAAAASASMVFVSWLPPLKLNGIIRKYTVFCSHPYPTVISEFEASPDSFSYRIPNLSRNRQYSVWVVAVTSAGRGNSSEIITVEPLAKAPARILTFSGTVTTPWMKDIVLPCKAVGDPSPAVKWMKDSNGTPSLVTIDGRRSIFSNGSFIIRTVKAEDSGYYSCIANNNWGSDEIILNLQVQVPPDQPRLTVSKTTSSSITLSWLPGDNGGSSIRGYILQYSEDNSEQWGSFPISPSERSYRLENLKCGTWYKFTLTAQNGVGPGRISEIIEAKTLGKEPQFSKEQELFASINTTRVRLNLIGWNDGGCPITSFTLEYRPFGTTVWTTAQRTSLSKSYILYDLQEATWYELQMRVCNSAGCAEKQANFATLNYDGSTIPPLIKSVVQNEEGLTTNEGLKM

SEQ ID NO: 2278 - protein, 1591 aa, synthetic construct
  REGION 1..1591: note = DSCAML1 (Q8TD84) SP+PP+ECD
MWLVTFLLLLDSLHKARPEDVGTSLYFVNDSLQQVTFSSSVGVVVPCPAAGSPSAALRWYLATGDDIYDVPHIRHVHANGTLQLYPFSPSAFNSFIHDNDYFCTAENAAGKIRSPNIRVKAVFREPYTVRVEDQRSMRGNVAVFKCLIPSSVQEYVSVVSWEKDTVSIIPEHRFFITYHGGLYISDVQKEDALSTYRCITKHKYSGETRQSNGARLSVTDPAESIPTILDGFHSQEVWAGHTVELPCTASGYPIPAIRWLKDGRPLPADSRWTKRITGLTISDLRTEDSGTYICEVTNTFGSAEATGILMVIDPLHVTLTPKKLKTGIGSTVILSCALTGSPEFTIRWYRNTELVLPDEAISIRGLSNETLLITSAQKSHSGAYQCFATRKAQTAQDFAIIALEDGTPRIVSSFSEKVVNPGEQFSLMCAAKGAPPPTVTWALDDEPIVRDGSHRTNQYTMSDGTTISHMNVTGPQIRDGGVYRCTARNLVGSAEYQARINVRGPPSIRAMRNITAVAGRDTLINCRVIGYPYYSIKWYKDALLLPDNHRQVVFENGTLKLTDVQKGMDEGEYLCSVLIQPQLSISQSVHVAVKVPPLIQPFEFPPASIGQLLYIPCVVSSGDMPIRITWRKDGQVIISGSGVTIESKEFMSSLQISSVSLKHNGNYTCIASNAAATVSRERQLIVRVPPRFVVQPNNQDGIYGKAGVLNCSVDGYPPPKVMWKHAKGSGNPQQYHPVPLTGRIQILPNSSLLIRHVLEEDIGYYLCQASNGVGTDISKSMFLTVKIPAMITSHPNTTIAIKGHAKELNCTARGERPIIIRWEKGDTVIDPDRVMRYAIATKDNGDEVVSTLKLKPADRGDSVFFSCHAINSYGEDRGLIQLTVQEPPDPPELEIREVKARSMNLRWTQRFDGNSIITGFDIEYKNKSDSWDFKQSTRNISPTINQANIVDLHPASVYSIRMYSFNKIGRSEPSKELTISTEEAAPDGPPMDVTLQPVTSQSIQVTWKAPKKELQNGVIRGYQIGYRENSPGSNGQYSIVEMKATGDSEVYTLDNLKKFAQYGVVVQAFNRAGTGPSSSEINATTLEDVPSQPPENVRALSITSDVAVISWSEPPRSTLNGVLKGYRVIFWSLYVDGEWGEMQNITTTRERVELRGMEKFTNYSVQVLAYTQAGDGVRSSVLYIQTKEDVPGPPAGIKAVPSSASSVVVSWLPPTKPNGVIRKYTIFCSSPGSGQPAPSEYETSPEQLFYRIAHLNRGQQYLLWVAAVTSAGRGNSSEKVTIEPAGKAPAKIISFGGTVTTPWMKDVRLPCNSVGDPAPAVKWTKDSEDSAIPVSMDGHRLIHTNGTLLLRAVKAEDSGYYTCTATNTGGFDTIIVNLLVQVPPDQPRLTVSKTSASSITLTWIPGDNGGSSIRGFVLQYSVDNSEEWKDVFISSSERSFKLDSLKCGTWYKVKLAAKNSVGSGRISEIIEAKTHGREPSFSKDQHLFTHINSTHARLNLQGWNNGGCPITAIVLEYRPKGTWAWQGLRANSSGEVFLTELREATWYELRMRACNSAGCGNETAQFATLDYDGSTIPPIKSAQGEGDDVKK

SEQ ID NO: 2279 - protein, 548 aa, synthetic construct
  REGION 1..548: note = DSG1 (Q02413) SP+PP+ECD
MDWSFFRVVAMLFIFLVVVEVNSEFRIQVRDYNTKNGTIKWHSIRRQKREWIKFAAACREGEDNSKRNPIAKIHSDCAANQQVTYRISGVGIDQPPYGIFVINQKTGEINITSIVDREVTPFFIIYCRALNSMGQDLERPLELRVRVLDINDNPPVFSMATFAGQIEENSNANTLVMILNATDADEPNNLNSKIAFKIIRQEPSDSPMFIINRNTGEIRTMNNFLDREQYGQYALAVRGSDRDGGADGMSAECECNIKILDVNDNIPYMEQSSYTIEIQENTLNSNLLEIRVIDLDEEFSANWMAVIFFISGNEGNWFEIEMNERTNVGILKVVKPLDYEAMQSLQLSIGVRNKAEFHHSIMSQYKLKASAISVTVLNVIEGPVFRPGSKTYVVTGNMGSNDKVGDFVATDLDTGRPSTTVRYVMGNNPADLLAVDSRTGKLTLKNKVTKEQYNMLGGKYQGTILSIDDNLQRTCTGTININIQSFGNDDRTNTEPNTKITTNTGRQESTSSTNYDTSTTSTDSSQVYSSEPGNGAKDLLSDNVHFGP

SEQ ID NO: 2280 - protein, 609 aa, synthetic construct
  REGION 1..609: note = DSG2 (Q14126) SP+PP+ECD
MARSPGRAYALLLLLICFNVGSGLHLQVLSTRNENKLLPKHPHLVRQKRAWITAPVALREGEDLSKKNPIAKIHSDLAEERGLKITYKYTGKGITEPPFGIFVFNKDTGELNVTSILDREETPFFLLTGYALDARGNNVEKPLELRIKVLDINDNEPVFTQDVFVGSVEELSAAHTLVMKINATDADEPNTLNSKISYRIVSLEPAYPPVFYLNKDTGEIYTTSVTLDREEHSSYTLTVEARDGNGEVTDKPVKQAQVQIRILDVNDNIPVVENKVLEGMVEENQVNVEVTRIKVFDADEIGSDNWLANFTFASGNEGGYFHIETDAQTNEGIVTLIKEVDYEEMKNLDFSVIVANKAAFHKSIRSKYKPTPIPIKVKVKNVKEGIHFKSSVISIYVSESMDRSSKGQIIGNFQAFDEDTGLPAHARYVKLEDRDNWISVDSVTSEIKLAKLPDFESRYVQNGTYTVKIVAISEDYPRKTITGTVLINVEDINDNCPTLIEPVQTICHDAEYVNVTAEDLDGHPNSGPFSFSVIDKPPGMAEKWKIARQESTSVLLQQSEKKLGRSEIQFLISDNQGFSCPEKQVLTLTVCECLHGSGCREAQHDSYVG

SEQ ID NO: 2281 - protein, 615 aa, synthetic construct
  REGION 1..615: note = DSG3 (P32926) SP+PP+ECD
MMGLFPRTTGALAIFVVVILVHGELRIETKGQYDEEEMTMQQAKRRQKREWVKFAKPCREGEDNSKRNPIAKITSDYQATQKITYRISGVGIDQPPFGIFVVDKNTGDINITAIVDREETPSFLITCRALNAQGLDVEKPLILTVKILDINDNPPVFSQQIFMGEIEENSASNSLVMILNATDADEPNHLNSKIAFKIVSQEPAGTPMFLLSRNTGEVRTLTNSLDREQASSYRLVVSGADKDGEGLSTQCECNIKVKDVNDNFPMFRDSQYSARIEENILSSELLRFQVTDLDEEYTDNWLAVYFFTSGNEGNWFEIQTDPRTNEGILKVVKALDYEQLQSVKLSIAVKNKAEFHQSVISRYRVQSTPVTIQVINVREGIAFRPASKTFTVQKGISSKKLVDYILGTYQAIDEDTNKAASNVKYVMGRNDGGYLMIDSKTAEIKFVKNMNRDSTFIVNKTITAEVLAIDEYTGKTSTGTVYVRVPDFNDNCPTAVLEKDAVCSSSPSVVVSARTLNNRYTGPYTFALEDQPVKLPAVWSITTLNATSALLRAQEQIPPGVYHISLVLTDSQNNRCEMPRSLTLEVCQCDNRGICGTSYPTTSPGTRYGRPHSGR

SEQ ID NO: 2282 - protein, 631 aa, synthetic construct
  REGION 1..631: note = DSG4 (Q86SJ6) SP+PP+ECD
MDWLFFRNICLLIILMVVMEVNSEFIVEVKEFDIENGTTKWQTVRRQKREWIKFAAACREGEDNSKRNPIAKIRSDCESNQKITYRISGVGIDRPPYGVFTINPRTGEINITSVVDREITPLFLIYCRALNSRGEDLERPLELRVKVMDINDNAPVFSQSVYTASIEENSDANTLVVKLCATDADEENHLNSKIAYKIVSQEPSGAPMFILNRYTGEVCTMSSFLDREQHSMYNLVVRGSDRDGAADGLSSECDCRIKVLDVNDNFPTLEKTSYSASIEENCLSSELIRLQAIDLDEEGTDNWLAQYLILSGNDGNWFDIQTDPQTNEGILKVVKMLDYEQAPNIQLSIGVKNQADFHYSVASQFQMHPTPVRIQVVDVREGPAFHPSTMAFSVREGIKGSSLLNYVLGTYTAIDLDTGNPATDVRYIIGHDAGSWLKIDSRTGEIQFSREFDKKSKYIINGIYTAEILAIDDGSGKTATGTICIEVPDINDYCPNIFPERRTICIDSPSVLISVNEHSYGSPFTFCVVDEPPGIADMWDVRSTNATSAILTAKQVLSPGFYEIPILVKDSYNRACELAQMVQLYACDCDDNHMCLDSGAAGIYTEDITGDTYGPVTEDQAGVSNVGLGPA

SEQ ID NO: 2283 - protein, 124 aa, synthetic construct
  REGION 1..124: note = ECSCR (Q19T08) SP+PP+ECD
MGTAGAMQLCWVILGFLLFRGHNSQPTMTQTSSSQGGLGGLSLTTEPVSSNPGYIPSSEANRPSHLSSTGTPGAGVPSSGRDGGTSRDTFQTVPPNSTTMSLSMREDATILPSPTSETVLTVAA

SEQ ID NO: 2284 - protein, 187 aa, synthetic construct
  REGION 1..187: note = EDAR (Q9UNE0) SP+PP+ECD
MAHVGDCTQTPWLPVLVVSLMCSARAEYSNCGENEYYNQTTGLCQECPPCGPGEEPYLSCGYGTKDEDYGCVPCPAEKFSKGGYQICRRHKDCEGFFRATVLTPGDMENDAECGPCLPGYYMLENRPRNIYGMVCYSCLLAPPNTKECVGATSGASANFPGTSGSSTLSPFQHAHKELSGQGHLATA

SEQ ID NO: 2285 - protein, 237 aa, synthetic construct
  REGION 1..237: note = EFNB1 (P98172) SP+PP+ECD
MARPGQRWLGKWLVAMVVWALCRLATPLAKNLEPVSWSSLNPKFLSGKGLVIYPKIGDKLDIICPRAEAGRPYEYYKLYLVRPEQAAACSTVLDPNVLVTCNRPEQEIRFTIKFQEFSPNYMGLEFKKHHDYYITSTSNGSLEGLENREGGVCRTRTMKIIMKVGQDPNAVTPEQLTTSRPSKEADNTVKMATQAPGSRGSLGDSDGKHETVNQEEKSGPGASGGSSGDPDGFFNSK

SEQ ID NO: 2286 - protein, 229 aa, synthetic construct
  REGION 1..229: note = EFNB2 (P52799) SP+PP+ECD
MAVRRDSVWKYCWGVLMVLCRTAISKSIVLEPIYWNSSNSKFLPGQGLVLYPQIGDKLDIICPKVDSKTVGQYEYYKVYMVDKDQADRCTIKKENTPLLNCAKPDQDIKFTIKFQEFSPNLWGLEFQKNKDYYIISTSNGSLEGLDNQEGGVCQTRAMKILMKVGQDASSAGSTRNKDPTRRPELEAGTNGRSSTTSPFVKPNPGSSTDGNSAGHSGNNILGSEVALFA

SEQ ID NO: 2287 - protein, 226 aa, synthetic construct
  REGION 1..226: note = EFNB3 (Q15768) SP+PP+ECD
MGPPHSGPGGVRVGALLLLGVLGLVSGLSLEPVYWNSANKRFQAEGGYVLYPQIGDRLDLLCPRARPPGPHSSPNYEFYKLYLVGGAQGRRCEAPPAPNLLLTCDRPDLDLRFTIKFQEYSPNLWGHEFRSHHDYYIIATSDGTREGLESLQGGVCLTRGMKVLLRVGQSPRGGAVPRKPVSEMPMERDRGAAHSLEPGKENLPGDPTSNATSRGAEGPLPPPSMP

SEQ ID NO: 2288 - protein, 1032 aa, synthetic construct
  REGION 1..1032: note = EGF (P01133) SP+PP+ECD
MLLTLIILLPVVSKFSFVSLSAPQHWSCPEGTLAGNGNSTCVGPAPFLIFSHGNSIFRIDTEGTNYEQLVVDAGVSVIMDFHYNEKRIYWVDLERQLLQRVFLNGSRQERVCNIEKNVSGMAINWINEEVIWSNQQEGIITVTDMKGNNSHILLSALKYPANVAVDPVERFIFWSSEVAGSLYRADLDGVGVKALLETSEKITAVSLDVLDKRLFWIQYNREGSNSLICSCDYDGGSVHISKHPTQHNLFAMSLFGDRIFYSTWKMKTIWIANKHTGKDMVRINLHSSFVPLGELKVVHPLAQPKAEDDTWEPEQKLCKLRKGNCSSTVCGQDLQSHLCMCAEGYALSRDRKYCEDVNECAFWNHGCTLGCKNTPGSYYCTCPVGFVLLPDGKRCHQLVSCPRNVSECSHDCVLTSEGPLCFCPEGSVLERDGKTCSGCSSPDNGGCSQLCVPLSPVSWECDCFPGYDLQLDEKSCAASGPQPFLLFANSQDIRHMHFDGTDYGTLLSQQMGMVYALDHDPVENKIYFAHTALKWIERANMDGSQRERLIEEGVDVPEGLAVDWIGRRFYWTDRGKSLIGRSDLNGKRSKIITKENISQPRGIAVHPMAKRLFWTDTGINPRIESSSLQGLGRLVIASSDLIWPSGITIDFLTDKLYWCDAKQSVIEMANLDGSKRRRLTQNDVGHPFAVAVFEDYVWFSDWAMPSVMRVNKRTGKDRVRLQGSMLKPSSLVVVHPLAKPGADPCLYQNGGCEHICKKRLGTAWCSCREGFMKASDGKTCLALDGHQLLAGGEVDLKNQVTPLDILSKTRVSEDNITESQHMLVAEIMVSDQDDCAPVGCSMYARCISEGEDATCQCLKGFAGDGKLCSDIDECEMGVPVCPPASSKCINTEGGYVCRCSEGYQGDGIHCLDIDECQLGEHSCGENASCTNTEGGYTCMCAGRLSEPGLICPDSTPPPHLREDDHHYSVRNSDSECPLSHDGYCLHDGVCMYIEALDKYACNCVVGYIGERCQYRDLKWWELRHAGHGQQQK

SEQ ID NO: 2289 - protein, 645 aa, synthetic construct
  REGION 1..645: note = EGFR (P00533) SP+PP+ECD
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPS

SEQ ID NO: 2290 - protein, 418 aa, synthetic construct
  REGION 1..418: note = ELFN1 (P0C7U0) SP+PP+ECD
MAGRGWGALWVCVAAATLLHAGGLARADCWLIEGDKGFVWLAICSQNQPPYEAIPQQINSTIVDLRLNENRIRSVQYASLSRFGNLTYLNLTKNEIGYIEDGAFSGQFNLQVLQLGYNRLRNLTEGMLRGLGKLEYLYLQANLIEVVMASSFWECPNIVNIDLSMNRIQQLNSGTFAGLAKLSVCELYSNPFYCSCELLGFLRWLAAFTNATQTYDRMQCESPPVYSGYYLLGQGRRGHRSILSKLQSVCTEDSYAAEVVGPPRPASGRSQPGRSPPPPPPPEPSDMPCADDECFSGDGTTPLVALPTLATQAEARPLIKVKQLTQNSATITVQLPSPFHRMYTLEHFNNSKASTVSRLTKAQEEIRLTNLFTLTNYTYCVVSTSAGLRHNHTCLTICLPRLPSPPGPVPSPSTATHY

SEQ ID NO: 2291 - protein, 397 aa, synthetic construct
  REGION 1..397: note = ELFN2 (Q5R3F8) SP+PP+ECD
MLRLGLCAAALLCVCRPGAVRADCWLIEGDKGYVWLAICSQNQPPYETIPQHINSTVHDLRLNENKLKAVLYSSLNRFGNLTDLNLTKNEISYIEDGAFLGQSSLQVLQLGYNKLSNLTEGMLRGMSRLQFLFVQHNLIEVVTPTAFSECPSLISIDLSSNRLSRLDGATFASLASLMVCELAGNPFNCECDLFGFLAWLVVFNNVTKNYDRLQCESPREFAGYPLLVPRPYHSLNAITVLQAKCRNGSLPARPVSHPTPYSTDAQREPDENSGFNPDEILSVEPPASSTTDASAGPAIKLHHVTFTSATLVVIIPHPYSKMYILVQYNNSYFSDVMTLKNKKEIVTLDKLRAHTEYTFCVTSLRNSRRFNHTCLTFTTRDPVPGDLAPSTSTTTHY

SEQ ID NO: 2292 - protein, 260 aa, synthetic construct
  REGION 1..260: note = EMB (Q6PCB8) SP+PP+ECD
MRALPGLLEARARTPRLLLLQCLLAAARPSSADGSAPDSPFTSPPLREEIMANNFSLESHNISLTEHSSMPVEKNITLERPSNVNLTCQFTTSGDLNAVNVTWKKDGEQLENNYLVSATGSTLYTQYRFTIINSKQMGSYSCFFREEKEQRGTFNFKVPELHGKNKPLISYVGDSTVLTCKCQNCFPLNWTWYSSNGSVKVPVGVQMNKYVINGTYANETKLKITQLLEEDGESYWCRALFQLGESEEHIELVVLSYLVP

SEQ ID NO: 2293 - protein, 190 aa, synthetic construct
  REGION 1..190: note = EMCN (Q9ULC0) SP+PP+ECD
MELLQVTILFLLPSICSSNSTGVLEAANNSLVVTTTKPSITTPNTESLQKNVVTPTTGTTPKGTITNELLKMSLMSTATFLTSKDEGLKATTTDVRKNDSIISNVTVTSVTLPNAVSTLQSSKPKTETQSSIKTTEIPGSVLQPDASPSKTGTLTSIPVTIPENTSQSQVIGTEGGKNASTSATSRSYSS

SEQ ID NO: 2294 - protein, 586 aa, synthetic construct
  REGION 1..586: note = ENG (P17813) SP+PP+ECD
MDRGTLPLAVALLLASCSLSPTSLAETVHCDLQPVGPERGEVTYTTSQVSKGCVAQAPNAILEVHVLFLEFPTGPSQLELTLQASKQNGTWPREVLLVLSVNSSVFLHLQALGIPLHLAYNSSLVTFQEPPGVNTTELPSFPKTQILEWAAERGPITSAAELNDPQSILLRLGQAQGSLSFCMLEASQDMGRTLEWRPRTPALVRGCHLEGVAGHKEAHILRVLPGHSAGPRTVTVKVELSCAPGDLDAVLILQGPPYVSWLIDANHNMQIWTTGEYSFKIFPEKNIRGFKLPDTPQGLLGEARMLNASIVASFVELPLASIVSLHASSCGGRLQTSPAPIQTTPPKDTCSPELLMSLIQTKCADDAMTLVLKKELVAHLKCTITGLTFWDPSCEAEDRGDKFVLRSAYSSCGMQVSASMISNEAVVNILSSSSPQRKKVHCLNMDSLSFQLGLYLSPHFLQASNTIEPGQQSFVQVRVSPSVSEFLLQLDSCHLDLGPEGGTVELIQGRAAKGNCVSLLSPSPEGDPRFSFLLHFYTVPIPKTGTLSCTVALRPKTGSQDQEVHRTVFMRLNIISPDLSGCTSKG

SEQ ID NO: 2295 - protein, 407 aa, synthetic construct
  REGION 1..407: note = ENPP4 (Q9Y6X5) SP+PP+ECD
MKLLVILLFSGLITGFRSDSSSSLPPKLLLVSFDGFRADYLKNYEFPHLQNFIKEGVLVEHVKNVFITKTFPNHYSIVTGLYEESHGIVANSMYDAVTKKHFSDSNDKDPFWWNEAVPIWVTNQLQENRSSAAAMWPGTDVPIHDTISSYFMNYNSSVSFEERLNNITMWLNNSNPPVTFATLYWEEPDASGHKYGPEDKENMSRVLKKIDDLIGDLVQRLKMLGLWENLNVIITSDHGMTQCSQDRLINLDSCIDHSYYTLIDLSPVAAILPKINRTEVYNKLKNCSPHMNVYLKEDIPNRFYYQHNDRIQPIILVADEGWTIVLNESSQKLGDHGYDNSLPSMHPFLAAHGPAFHKGYKHSTINIVDIYPMMCHILGLKPHPNNGTFGHTKCLLVDQWCINLPEA

SEQ ID NO: 2296 - protein, 431 aa, synthetic construct
  REGION 1..431: note = ENPP5 (Q9UJA9) SP+PP+ECD
MTSKFLLVSFILAALSLSTTFSLQPDQQKVLLVSFDGFRWDYLYKVPTPHFHYIMKYGVHVKQVTNVFITKTYPNHYTLVTGLFAENHGIVANDMFDPIRNKSFSLDHMNIYDSKFWEEATPIWITNQRAGHTSGAAMWPGTDVKIHKRFPTHYMPYNESVSFEDRVAKIIEWFTSKEPINLGLLYWEDPDDMGHHLGPDSPLMGPVISDIDKKLGYLIQMLKKAKLWNTLNLIITSDHGMTQCSEERLIELDQYLDKDHYTLIDQSPVAAILPKEGKFDEVYEALTHAHPNLTVYKKEDVPERWHYKYNSRIQPIIAVADEGWHILQNKSDDFLLGNHGYDNALADMHPIFLAHGPAFRKNFSKEAMNSTDLYPLLCHLLNITAMPHNGSFWNVQDLLNSAMPRVVPYTQSTILLPGSVKPAEYDQEGSY

SEQ ID NO: 2297 - protein, 265 aa, synthetic construct
  REGION 1..265: note = EPCAM (P16422) SP+PP+ECD
MAPPQVLAFGLLLAAATATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSMCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLK

SEQ ID NO: 2298 - protein, 110 aa, synthetic construct
  REGION 1..110: note = EPGN (Q6UW88) SP+PP+ECD
MALGVPISVYLLFNAMTALTEEAAVTVTPPITAQQGNWTVNKTEADNIEGPIALKFSHLCLEDHNSYCINGACAFHHELEKAICRCFTGYTGERCEHLTLTSYAVDSYEK

SEQ ID NO: 2299 - protein, 547 aa, synthetic construct
  REGION 1..547: note = EPHA1 (P21709) SP+PP+ECD
MERRWPLGLGLVLLLCAPLPPGARAKEVTLMDTSKAQGELGWLLDPPKDGWSEQQQILNGTPLYMYQDCPMQGRRDTDHWLRSNWIYRGEEASRVHVELQFTVRDCKSFPGGAGPLGCKETFNLLYMESDQDVGIQLRRPLFQKVTTVAADQSFTIRDLVSGSVKLNVERCSLGRLTRRGLYLAFHNPGACVALVSVRVFYQRCPETLNGLAQFPDTLPGPAGLVEVAGTCLPHARASPRPSGAPRMHCSPDGEWLVPVGRCHCEPGYEEGGSGEACVACPSGSYRMDMDTPHCLTCPQQSTAESEGATICTCESGHYRAPGEGPQVACTGPPSAPRNLSFSASGTQLSLRWEPPADTGGRQDVRYSVRCSQCQGTAQDGGPCQPCGVGVHFSPGARGLTTPAVHVNGLEPYANYTFNVEAQNGVSGLGSSGHASTSVSISMGHAESLSGLSLRLVKKEPRQLELTWAGSRPRSPGANLTYELHVLNQDEERYQMVLEPRVLLTELQPDTTYIVRVRMLTPLGPGPFSPDHEFRTSPPVSRGLTGGE

SEQ ID NO: 2300 - protein, 565 aa, synthetic construct
  REGION 1..565: note = EPHA10 (Q5JZY3) SP+PP+ECD
METCAGPHPLRLFLCRMQLCLALLLGPWRPGTAEEVILLDSKASQAELGWTALPSNGWEEISGVDEHDRPIRTYQVCNVLEPNQDNWLQTGWISRGRGQRIFVELQFTLRDCSSIPGAAGTCKETFNVYYLETEADLGRGRPRLGGSRPRKIDTIAADESFTQGDLGERKMKLNTEVREIGPLSRRGFHLAFQDVGACVALVSVRVYYKQCRATVRGLATFPATAAESAFSTLVEVAGTCVAHSEGEPGSPPRMHCGADGEWLVPVGRCSCSAGFQERGDFCEACPPGFYKVSPRRPLCSPCPEHSRALENASTFCVCQDSYARSPTDPPSASCTRPPSAPRDLQYSLSRSPLVLRLRWLPPADSGGRSDVTYSLLCLRCGREGPAGACEPCGPRVAFLPRQAGLRERAATLLHLRPGARYTVRVAALNGVSGPAAAAGTTYAQVTVSTGPGAPWEEDEIRRDRVEPQSVSLSWREPIPAGAPGANDTEYEIRYYEKGQSEQTYSMVKTGAPTVTVTNLKPATRYVFQIRAASPGPSWEAQSFNPSIEVQTLGEAASGSRDQSPA

SEQ ID NO: 2301 - protein, 537 aa, synthetic construct
  REGION 1..537: note = EPHA2 (P29317) SP+PP+ECD
MELQAARACFALLWGCALAAAAAAQGKEVVLLDFAAAGGELGWLTHPYGKGWDLMQNIMNDMPIYMYSVCNVMSGDQDNWLRTNWVYRGEAERIFIELKFTVRDCNSFPGGASSCKETFNLYYAESDLDYGTNFQKRLFTKIDTIAPDEITVSSDFEARHVKLNVEERSVGPLTRKGFYLAFQDIGACVALLSVRVYYKKCPELLQGLAHFPETIAGSDAPSLATVAGTCVDHAVVPPGGEEPRMHCAVDGEWLVPIGQCLCQAGYEKVEDACQACSPGFFKFEASESPCLECPEHTLPSPEGATSCECEEGFFRAPQDPASMPCTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSPEGSGNLAV

SEQ ID NO: 2302 - protein, 541 aa, synthetic construct
  REGION 1..541: note = EPHA3 (P29320) SP+PP+ECD
MDCQLSILLLLSCSVLDSFGELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDDHGVKFREHQFTKIDTIAADESFTQMDLGDRILKLNTEIREVGPVNKKGFYLAFQDVGACVALVSVRVYFKKCPFTVKNLAMFPDTVPMDSQSLVEVRGSCVNNSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDWSWPLDTGGRKDVTFNIICKKCGWNIKQCEPCSPNVRFLPRQFGLTNTTVTVTDLLAHTNYTFEIDAVNGVSELSSPPRQFAAVSITTNQAAPSPVLTIKKDRTSRNSISLSWQEPEHPNGIILDYEVKYYEKQEQETSYTILRARGTNVTISSLKPDTIYVFQIRARTAAGYGTNSRKFEFETSPDSFSISGESSQ

SEQ ID NO: 2303 - protein, 547 aa, synthetic construct
  REGION 1..547: note = EPHA4 (P54764) SP+PP+ECD
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANST

SEQ ID NO: 2304 - protein, 573 aa, synthetic construct
  REGION 1..573: note = EPHA5 (P54756) SP+PP+ECD
MRGSGPRGAGRRRPPSGGGDTPITPASLAGCYSAPRRAPLWTCLLLCAALRTLLASPSNEVNLLDSRTVMGDLGWIAFPKNGWEEIGEVDENYAPIHTYQVCKVMEQNQNNWLLTSWISNEGASRIFIELKFTLRDCNSLPGGLGTCKETFNMYYFESDDQNGRNIKENQYIKIDTIAADESFTELDLGDRVMKLNTEVRDVGPLSKKGFYLAFQDVGACIALVSVRVYYKKCPSVVRHLAVFPDTITGADSSQLLEVSGSCVNHSVTDEPPKMHCSAEGEWLVPIGKCMCKAGYEEKNGTCQVCRPGFFKASPHIQSCGKCPPHSYTHEEASTSCVCEKDYFRRESDPPTMACTRPPSAPRNAISNVNETSVFLEWIPPADTGGRKDVSYYIACKKCNSHAGVCEECGGHVRYLPRQSGLKNTSVMMVDLLAHTNYTFEIEAVNGVSDLSPGARQYVSVNVTTNQAAPSPVTNVKKGKIAKNSISLSWQEPDRPNGIILEYEIKYFEKDQETSYTIIKSKETTITAEGLKPASVYVFQIRARTAAGYGVFSRRFEFETTPVFAASSDQSQIP

SEQ ID NO: 2305 - protein, 550 aa, synthetic construct
  REGION 1..550: note = EPHA6 (Q9UF33) SP+PP+ECD
MGGCEVREFLLQFGFFLPLLTAWPGDCSHVSNNQVVLLDTTTVLGELGWKTYPLNGWDAITEMDEHNRPIHTYQVCNVMEPNQNNWLRTNWISRDAAQKIYVEMKFTLRDCNSIPWVLGTCKETFNLFYMESDESHGIKFKPNQYTKIDTIAADESFTQMDLGDRILKLNTEIREVGPIERKGFYLAFQDIGACIALVSVRVFYKKCPFTVRNLAMFPDTIPRVDSSSLVEVRGSCVKSAEERDTPKLYCGADGDWLVPLGRCICSTGYEEIEGSCHACRPGFYKAFAGNTKCSKCPPHSLTYMEATSVCQCEKGYFRAEKDPPSMACTRPPSAPRNVVFNINETALILEWSPPSDTGGRKDLTYSVICKKCGLDTSQCEDCGGGLRFIPRHTGLINNSVIVLDFVSHVNYTFEIEAMNGVSELSFSPKPFTAITVTTDQDAPSLIGVVRKDWASQNSIALSWQAPAFSNGAILDYEIKYYEKEHEQLTYSSTRSKAPSVIITGLKPATKYVFHIRVRTATGYSGYSQKFEFETGDETSDMAAEQGQILV

SEQ ID NO: 2306 - protein, 555 aa, synthetic construct
  REGION 1..555: note = EPHA7 (Q15375) SP+PP+ECD
MVFQTRYPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENAPRMHCSAEGEWLVPIGKCICKAGYQQKGDTCEPCGRGFYKSSSQDLQCSRCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATGKMFEATAVSSEQNPV

SEQ ID NO: 2307 - protein, 542 aa, synthetic construct
  REGION 1..542: note = EPHA8 (P29322) SP+PP+ECD
MAPARGRLPPALWVVTAAAAAATCVSAARGEVNLLDTSTIHGDWGWLTYPAHGWDSINEVDESFQPIHTYQVCNVMSPNQNNWLRTSWVPRDGARRVYAEIKFTLRDCNSMPGVLGTCKETFNLYYLESDRDLGASTQESQFLKIDTIAADESFTGADLGVRRLKLNTEVRSVGPLSKRGFYLAFQDIGACLAILSLRIYYKKCPAMVRNLAAFSEAVTGADSSSLVEVRGQCVRHSEERDTPKMYCSAEGEWLVPIGKCVCSAGYEERRDACVACELGFYKSAPGDQLCARCPPHSHSAAPAAQACHCDLSYYRAALDPPSSACTRPPSAPVNLISSVNGTSVTLEWAPPLDPGGRSDITYNAVCRRCPWALSRCEACGSGTRFVPQQTSLVQASLLVANLLAHMNYSFWIEAVNGVSDLSPEPRRAAVVNITTNQAAPSQVVVIRQERAGQTSVSLLWQEPEQPNGIILEYEIKYYEKDKEMQSYSTLKAVTTRATVSGLKPGTRYVFQVRARTSAGCGRFSQAMEVETGKPRPRYDTRT

SEQ ID NO: 2308 - protein, 540 aa, synthetic construct
  REGION 1..540: note = EPHB1 (P54762) SP+PP+ECD
MALDYLLLLLLASAVAAMEETLMDTRTATAELGWTANPASGWEEVSGYDENLNTIRTYQVCNVFEPNQNNWLLTTFINRRGAHRIYTEMRFTVRDCSSLPNVPGSCKETFNLYYYETDSVIATKKSAFWSEAPYLKVDTIAADESFSQVDFGGRLMKVNTEVRSFGPLTRNGFYLAFQDYGACMSLLSVRVFFKKCPSIVQNFAVFPETMTGAESTSLVIARGTCIPNAEEVDVPIKLYCNGDGEWMVPIGRCTCKPGYEPENSVACKACPAGTFKASQEAEGCSHCPSNSRSPAEASPICTCRTGYYRADFDPPEVACTSVPSGPRNVISIVNETSIILEWHPPRETGGRDDVTYNIICKKCRADRRSCSRCDDNVEFVPRQLGLTECRVSISSLWAHTPYTFDIQAINGVSSKSPFPPQHVSVNITTNQAAPSTVPIMHQVSATMRSITLSWPQPEQPNGIILDYEIRYYEKEHNEFNSSMARSQTNTARIDGLRPGMVYVVQVRARTVAGYGKFSGKMCFQTLTDDDYKSELREQLP

SEQ ID NO: 2309 - protein, 543 aa, synthetic construct
  REGION 1..543: note = EPHB2 (P29323) SP+PP+ECD
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPL

SEQ ID NO: 2310 - protein, 559 aa, synthetic construct
  REGION 1..559: note = EPHB3 (P54753) SP+PP+ECD
MARARPPPPPSPPPGLLPLLPPLLLLPLLLLPAGCRALEETLMDTKWVTSELAWTSHPESGWEEVSGYDEAMNPIRTYQVCNVRESSQNNWLRTGFIWRRDVQRVYVELKFTVRDCNSIPNIPGSCKETFNLFYYEADSDVASASSPFWMENPYVKVDTIAPDESFSRLDAGRVNTKVRSFGPLSKAGFYLAFQDQGACMSLISVRAFYKKCASTTAGFALFPETLTGAEPTSLVIAPGTCIPNAVEVSVPLKLYCNGDGEWMVPVGACTCATGHEPAAKESQCRPCPPGSYKAKQGEGPCLPCPPNSRTTSPAASICTCHNNFYRADSDSADSACTTVPSPPRGVISNVNETSLILEWSEPRDLGGRDDLLYNVICKKCHGAGGASACSRCDDNVEFVPRQLGLTERRVHISHLLAHTRYTFEVQAVNGVSGKSPLPPRYAAVNITTNQAAPSEVPTLRLHSSSGSSLTLSWAPPERPNGVILDYEMKYFEKSEGIASTVTSQMNSVQLDGLRPDARYVVQVRARTVAGYGQYSRPAEFETTSERGSGAQQLQEQLPL

SEQ ID NO: 2311 - protein, 539 aa, synthetic construct
  REGION 1..539: note = EPHB4 (P54760) SP+PP+ECD
MELRVLLCWASLAAALEETLLNTKLETADLKWVTFPQVDGQWEELSGLDEEQHSVRTYEVCDVQRAPGQAHWLRTGWVPRRGAVHVYATLRFTMLECLSLPRAGRSCKETFTVFYYESDADTATALTPAWMENPYIKVDTVAAEHLTRKRPGAEATGKVNVKTLRLGPLSKAGFYLAFQDQGACMALLSLHLFYKKCAQLTVNLTRFPETVPRELVVPVAGSCVVDAVPAPGPSPSLYCREDGQWAEQPVTGCSCAPGFEAAEGNTKCRACAQGTFKPLSGEGSCQPCPANSHSNTIGSAVCQCRVGYFRARTDPRGAPCTTPPSAPRSVVSRLNGSSLHLEWSAPLESGGREDLTYALRCRECRPGGSCAPCGGDLTFDPGPRDLVEPWVVVRGLRPDFTYTFEVTALNGVSSLATGPVPFEPVNVTTDREVPPAVSDIRVTRSSPSSLSLAWAVPRAPSGAVLDYEVKYHEKGAEGPSSVRFLKTSENRAELRGLKRGASYLVQVRARSEAGYGPFGQEHHSQTQLDESEGWREQLA

SEQ ID NO: 2312 - protein, 594 aa, synthetic construct
  REGION 1..594: note = EPHB6 (O15197) SP+PP+ECD
MATEGAAQLGNRVAGMVCSLWVLLLVSSVLALEEVLLDTTGETSEIGWLTYPPGGWDEVSVLDDQRRLTRTFEACHVAGAPPGTGQDNWLQTHFVERRGAQRAHIRLHFSVRACSSLGVSGGTCRETFTLYYRQAEEPDSPDSVSSWHLKRWTKVDTIAADESFPSSSSSSSSSSSAAWAVGPHGAGQRAGLQLNVKERSFGPLTQRGFYVAFQDTGACLALVAVRLFSYTCPAVLRSFASFPETQASGAGGASLVAAVGTCVAHAEPEEDGVGGQAGGSPPRLHCNGEGKWMVAVGGCRCQPGYQPARGDKACQACPRGLYKSSAGNAPCSPCPARSHAPNPAAPVCPCLEGFYRASSDPPEAPCTGPPSAPQELWFEVQGSALMLHWRLPRELGGRGDLLFNVVCKECEGRQEPASGGGGTCHRCRDEVHFDPRQRGLTESRVLVGGLRAHVPYILEVQAVNGVSELSPDPPQAAAINVSTSHEVPSAVPVVHQVSRASNSITVSWPQPDQTNGNILDYQLRYYDQAEDESHSFTLTSETNTATVTQLSPGHIYGFQVRARTAAGHGPYGGKVYFQTLPQGELSSQLPERLS

SEQ ID NO: 2313 - protein, 250 aa, synthetic construct
  REGION 1..250: note = EPOR (P19235) SP+PP+ECD
MDHLGASLWPQVGSLCLLLAGAAWAPPPNLPDPKFESKAALLAARGPEELLCFTERLEDLVCFWEEAASAGVGPGNYSFSYQLEDEPWKLCRLHQAPTARGAVRFWCSLPTADTSSFVPLELRVTAASGAPRYHRVIHINEVVLLDAPVGLVARLADESGHVVLRWLPPPETPMTSHIRYEVDVSAGNGAGSVQRVEILEGRTECVLSNLRGRTRYTFAVRARMAEPSFGGFWSAWSEPVSLLTPSDLDP

SEQ ID NO: 2314 - protein, 181 aa, synthetic construct
  REGION 1..181: note = EQTN (Q9NQ60) SP+PP+ECD
MNFILFIFIPGVFSLKSSTLKPTIEALPNVLPLNEDVNKQEEKNEDHTPNYAPANEKNGNYYKDIKQYVFTTQNPNGTESEISVRATTDLNFALKNDKTVNATTYEKSTIEEETTTSEPSHKNIQRSTPNVPAFWTMLAKAINGTAVVMDDKDQLFHPIPESDVNATQGENQPDLEDLKIK

SEQ ID NO: 2315 - protein, 652 aa, synthetic construct
  REGION 1..652: note = ERBB2 (P04626) SP+PP+ECD
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLT

SEQ ID NO: 2316 - protein, 643 aa, synthetic construct
  REGION 1..643: note = ERBB3 (P21860) SP+PP+ECD
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLT

SEQ ID NO: 2317 - protein, 651 aa, synthetic construct
  REGION 1..651: note = ERBB4 (Q15303) SP+PP+ECD
MKPATGLWVWVSLLVAAGTVQPSDSQSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTP

SEQ ID NO: 2318 - protein, 119 aa, synthetic construct
  REGION 1..119: note = EREG (O14944) SP+PP+ECD
MTAGRRMEMLCAGRVPALLLCLGFHLLQAVLSTTVIPSCIPGESSDNCTALVQTEDNPRVAQVSITKCSSDMNGYCLHGQCIYLVDMSQNYCRCEVGYTGVRCEHFFLTVHQPLSKEYV

SEQ ID NO: 2319 - protein, 155 aa, synthetic construct
  REGION 1..155: note = ERMAP (Q96PL5) SP+PP+ECD
MEMASSAGSWLSGCLIPLVFLRLSVHVSGHAGDAGKFHVALLGGTAELLCPLSLWPGTVPKEVRWLRSPFPQRSQAVHIFRDGKDQDEDLMPEYKGRTVLVRDAQEGSVTLQILDVRLEDQGSYRCLIQVGNLSKEDTVILQVAAPSVGSLSPSA

SEQ ID NO: 2320 - protein, 518 aa, synthetic construct
  REGION 1..518: note = ERVFC1 (P60507) SP+PP+ECD
MARPSPLCLLLLLTLLTPIVPSNSLLTEPPFRWRFYLHETWTQGNRLSTVTLATVDCQPHGCQAQVTFNFTSFKSVLRGWSNPTICFVYDQTHSNCRDYWVDTNGGCPYAYCRMHVTQLHTAKKLQHTYRLTSDGRTTYFLTIPDPWDSRWVSGVTGRLYRWPTDSYPVGKLRIFLTYIRVIPQVLSNLKDQADNIKHQEEVINTLVQSHPKADMVTYDDKAEAGPFSWITLVRHGARLVNMAGLVNLSHCFLCTALSQPPLVAVPLPQAFNTSGNHTAHPSGVFSEQVPLFRDPLQPQFPFCYTTPNSSWCNQTYSGSLSNLSAPAGGYFWCNFTLTKHLNISSNNTLSRNLCLPISLVPRLTLYSEAELSSLVNPPMRQKRAVFPPLVIGVSLTSSLVASGLGTGAIVHFISSSQDLSIKLQMAIEASAESLASLQRQITSVAKVAMQNRRALDLLTADKGGTCMFLGEECCYYINESGLVETSLLTLDKIRDGLHRPSSTPNYGGGWWQSPLTTW

SEQ ID NO: 2321 - protein, 518 aa, synthetic construct; identical to SEQ ID NO: 2320
  REGION 1..518: note = ERVFRD-1 (P60508) SP+PP+ECD

SEQ ID NO: 2322 - protein, 632 aa, synthetic construct
  REGION 1..632: note = ERVK-19 (O71037) SP+PP+ECD
MNPSEMQRKAPPRRRRHRNRAPLTHKMNKMVTSEEQMKLPSTKKAEPPTWAQLKKLTQLATKYLENTKVTQTPESMLLAALMIVSMVVSLPMPAGAAAANYTYWAYVPFPPLIRAVTWMDNPIEVYVNDSVWVPGPTDDHCPAKPEEEGMMINISIGYRYPPICLGRAPGCLMPAVQNWLVEVPTVSPISRFTYHMVSGMSLRPRVNYLQDFSYQRSFKFRPKGKPCPKEIPKESKNTEVLVWEECVANSAVILQNNEFGTIIDWAPRGQFYHNCSGQTQSCPSAQVSPAVDSDLTESLDKHKHKKLQSFYPWEWGEKGISTPRPKIISPVSGPEHPELWRLTVASHHIRIWSGNQTLETRDRKPFYTVDLNSSVTVPLQSCIKPPYMLVVGNIVIKPDSQTITCENCRLLTCIDSTFNWQHRILLVRAREGVWIPVSMDRPWETSPSIHTLTEVLKGVLNRSKRFIFTLIAVIMGLIAVTATAAVAGVALHSSVQSVNFVNDWQKNSTRLWNSQSSIDQKLANQINDLRQTVIWMGDRLMSLEHRFQLQCDWNTSDFSITPQIYNESEHHWDMVRRHLQGREDNLTLDISKLKEQIFEASKAHLNLVPGTEAIAGVADGLANLNPVTWVKT

SEQ ID NO: 2323 - protein, 631 aa, synthetic construct
  REGION 1..631: note = ERVK-21 (P61565) SP+PP+ECD
MHPSEMQRKAPPRRRRHRNRAPLTHKMNKMVTSEQMKLPSTKKAEPPTWAQLKKLTQLATKYLENTKVTQTPESMLLAALMIVSMVVSLPMPAGAAAANYTNWAYVPFPPLIRAVTWMDNPIEVYVNDSVWVHGPIDDRCPAKPEEEGMMINISIGYHYPPICLGRAPGCLMPAVQNWLVEVPTVSPISRFTYNMVSGMSLRPRVNYLQDFSYQRSLKFRPKGKPCPKEIPKESKNTEVLVWEECVANSVVILQNNEFGTIIDWAPRGQFYHNCSGQTQSCPSAQVSPAVDSDLTESLDKHKHKKLQSFYPWEWGEKGISTPRPKIISPVSGPEHPELWRLTVASHHIRIWSGNQTLETRDRKPFYTVDLNSSLTVPLQSCVKPPYMLVVGNIVIKPDSQTITCENCRLLTCIDSTFNWQHRILLVRAREGVWIPVSMDRPWEASPSIHILTEVLKGVLNRSKRFIFTLIAVIMGLIAVTAMAAVAGVALHSFVQSVNFVNDWQKNSTRLWNSQSSIDQKLANQINDLRQTVIWMGDRLMSLEHRFQLQCDWNTSDFCITPQIYNESEHHWDMVRRHLQGREDNLTLDISKLKEQIFEASKAHLNLVPGTEAIAGVADGLANLNPVTWVKT

SEQ ID NO: 2324 - protein, 632 aa, synthetic construct
  REGION 1..632: note = ERVK-6 (Q69384) SP+PP+ECD
MNPSEMQRKAPPRRRRHRNRAPLTHKMNKMVTSEEQMKLPSTKKAEPPTWAQLKKLTQLATKYLENTKVTQTPESMLLAALMIVSMVVSLPMPAGAAAANYTYWAYVPFPPLIRAVTWMDNPTEVYVNDSVWVPGPIDDRCPAKPEEEGMMINISIGYHYPPICLGRAPGCLMPAVQNWLVEVPTVSPICRFTYHMVSGMSLRPRVNYLQDFSYQRSLKFRPKGKPCPKEIPKESKNTEVLVWEECVANSAVILQNNEFGTIIDWAPRGQFYHNCSGQTQSCPSAQVSPAVDSDLTESLDKHKHKKLQSFYPWEWGEKGISTPRPKIVSPVSGPEHPELWRLTVASHHIRIWSGNQTLETRDRKPFYTIDLNSSLTVPLQSCVKPPYMLVVGNIVIKPDSQTITCENCRLLTCIDSTFNWQHRILLVRAREGVWIPVSMDRPWEASPSVHILTEVLKGVLNRSKRFIFTLIAVIMGLIAVTATAAVAGVALHSSVQSVNFVNDWQKNSTRLWNSQSSIDQKLANQINDLRQTVIWMGDRLMSLEHRFQLQCDWNTSDFCITPQIYNESEHHWDMVRRHLQGREDNLTLDISKLKEQIFEASKAHLNLVPGTEAIAGVADGLANLNPVTWVKT

SEQ ID NO: 2325 - protein, 632 aa, synthetic construct
  REGION 1..632: note = ERVK-8 (Q902F8) SP+PP+ECD
MNPSEMQRKAPPRRRRHRNRAPLTHKMNKMVTSEEQMKLPSTKKAEPPTWAQLKKLTQLATKYLENTKVTQTPESMLLAALMIVSMVVSLPMPAGAAVANYTNWAYVPFPPLIRAVTWMDNPIEVYVNDSVWVPGPIDDRCPAKPEEEGMMINISIGYRYPPICLGRAPGCLMPAVQNWLVEVPTVSPISRFTYHMVSGMSLRPRVNYLQDFSYQRSLKFRPKGKPCPKEIPKESKNTEVLVWEECVANSAVILQNNEFGTIIDWAPRGQFYHNCSGQTQSCPSAQVSPAVDSDLTESLDKHKHKKLQSFYPWEWGEKRISTPRPKIVSPVSGPEHPELWRLTVASHHIRIWSGNQTLETRDRKPFYTVDLNSSLTLPLQSCVKPPYMLVVGNIVIKPDSQTITCENCRLLTCIDSTFNWQHRILLVRAREGVWIPVSMDRPWEASPSVHILTEVLKGVLNRSKRFIFTLIAVIMGLIAVTATAAVAGVALHSSVQSVNFVNDGQKNSTRLWNSQSSIDQKLANQINDLRQTVIWMGDRLMSLEHRFQLQCDWNTSDFCITPQIYNDSEHHWDMVRRHLQGREDNLTLDISKLKEQIFEASKAHLNLVPGTEAIAGVADGLANLNPVTWVKT

SEQ ID NO: 2326 - protein, 631 aa, synthetic construct
  REGION 1..631: note = ERVK-9 (Q9UKH3) SP+PP+ECD
MNPSEMQRKAPPRRRRHRNRAPLTHKMNKMVTSEEQMKLPSTKKAEPPTWAQLKKLTQLATKYLENTKVTQTPESMLLAALMIVSMVVSLPMPAGAAAANYTNWAYVPFPPLIRAVTWMDNPIEVYVNDSVWVPGPIDDRCPAKPEEEGMMINISIGYRYPICLGRAPGCLMPAVQNWLVEVPIVSPICRFTYHMVSGMSLRPRVNYLQDFSYQRSLKFRPKGKPCPKEIPKESKNTEVLVWEECVANSAVILQNNEFGTIIDWTPQGQFYHNCSGQTQSCPSAQVSPAVDSDLTESLDKHKHKKLQSFYPWEWGEKGISTPRPKIISPVSGPEHPELWRLTVASHHIRIWSGNQTLETRDRKPFYTVDLNSSLTLPLQSCVKPPYMLVVGNIVIKPDSQTITCENCRLLTCIDSTFNWQHRILLVRAREGVWIPVSMDRPWEASPSIHILTEVLKGVLNRSKRFIFTLIAVIMGLIAVTATAAVAGVALHSSVQSVNFVNDGQKNSTRLWNSQSSIDQKLANQINDLRQTVIWMGDRLMSLEHRFQLQCDWNTSDFCITPQIYNESEHHWDMVRRHLQGREDNLTLDISKLKEQIFEASKAHLNLVPGTEAIAGVADGLANLNPVTWVKT

SEQ ID NO: 2327 - protein, 488 aa, synthetic construct
  REGION 1..488: note = ERVMER34-1 (Q9H9K5) SP+PP+ECD
MGSLSNYALLQLTLTAFLTILVQPQHLLAPVFRTLSILTNQSNCWLCEHLDNAEQPELVFVPASASTWWTYSGQWMYERVWYPQAEVQNHSTSSYRKVTWHWEASMEAQGLSFAQVRLLEGNFSLCVENKNGSGPFLGNIPKQYCNQILWFDSTDGTFMPSIDVTNESRNDDDDTSVCLGTRQCSWFAGCTNRTWNSSAVPLIGLPNTQDYKWVDRNSGLTWSGNDTCLYSCQNQTKGLLYQLFRNLFCSYGLTEAHGKWRCADASITNDKGHDGHRTPTWWLTGSNLTLSVNNSGLFFLCGNGVYKGFPPKWSGRCGLGYLVPSLTRYLTLNASQITNLRSFIHKVTPHRCTQGDTDNPPLYCNPKDNSTIRALFPSLGTYDLEKAILNISKAMEQEFSATKQTLEAHQSKVSSLASASRKDHVLDIPTTQRQTACGTVGKQCCLYINYSEEIKSNIQRLHEASENLKNVPLLDWQGIFAKVGDWFR

SEQ ID NO: 2328 - protein, 451 aa, synthetic construct; identical to SEQ ID NO: 1224
  REGION 1..451: note = ERVPABLB-1 (P60509) SP+PP+ECD

SEQ ID NO: 2329 - protein, 575 aa, synthetic construct
  REGION 1..575: note = ERVS71-1 (P61550) SP+PP+ECD
MGPEAWVRPLKTAPKPGEAIRLILFIYLSCFFLPVMSSEPSYSFLLTSFTTGRVFANTTWRAGTSKEVSFAVDLCVLFPEPARTHEEQHNLPVIGAGSVDLAAGFGHSGSQTGCGSSKGAEKGLQNVDFYLCPGNHPDASCRDTYQFFCPDWTCVTLATYSGGSTRSSTLSISRVPHPKLCTRKNCNPLTITVHDPNAAQWYYGMSWGLRLYIPGFDVGTMFTIQKKILVSWSSPKPIGPLTDLGDPIFQKHPDKVDLTVPLPFLVPRPQLQQQHLQPSLMSILGGVHHLLNLTQPKLAQDCWLCLKAKPPYYVGLGVEATLKRGPLSCHTRPRALTIGDVSGNASCLISTGYNLSASPFQATCNQSLLTSISTSVSYQAPNNTWLACTSGLTRCINGTEPGPLLCVLVHVLPQVYVYSGPEGRQLIAPPELHPRLHQAVPLLVPLLAGLSIAGSAAIGTAALVQGETGLISLSQQVDADFSNLQSAIDILHSQVESLAEVVLQNCRCLDLLFLSQGGLCAALGESCCFYANQSGVIKGTVKKVRENLDRHQQERENNIPWYQSMFNWNPWLTTL

SEQ ID NO: 2330 - protein, 321 aa, synthetic construct
  REGION 1..321: note = ERVV-1 (B6SEH8) SP+PP+ECD
MTEKFLFLYLSLLPMPLLSQAQWNENSLVSFSKIIASGNHLSNCWICHNFITRSSSYQYILVRNFSLNLTFGSGIPEGQHKSVPLQVSLANSAHQVPCLDLTPPFNQSSKTSFYFYNCSSLNQTCCPCPEGHCDRKNTSEEGFPSPTIHPMSFSPAGCHPNLTHWCPAKQMNDYRDKSPQNRCAAWEGKELITWRVLYLLPKAHTVPTWPKSTVPLGGPLSPACNQTIPAGWKSQLHKWFDSHIPRWACTPPGYVFLCGPQKNKLPFDGSPKITYSTPPVANLYTCINNIQHTGECAVGLLGPRGIGVTIYNTTQPRQKRA

SEQ ID NO: 2331 - protein, 443 aa, synthetic construct
  REGION 1..443: note = ERVW-1 (Q9UQF0) SP+PP+ECD
MALPYHIFLFTVLLPSFTLTAPPPCRCMTSSSPYQEFLWRMQRPGNIDAPSYRSLSKGTPTFTAHTHMPRNCYHSATLCMHANTHYWTGKMINPSCPGGLGVTVCWTYFTQTGMSDGGGVQDQAREKHVKEVISQLTRVHGTSSPYKGLDLSKLHETLRTHTRLVSLFNTTLTGLHEVSAQNPTNCWICLPLNFRPYVSIPVPEQWNNFSTEINTTSVLVGPLVSNLEITHTSNLTCVKFSNTTYTTNSQCIRWVTPPTQIVCLPSGIFFVCGTSAYRCLNGSSESMCFLSFLVPPMTIYTEQDLYSYVISKPRNKRVPILPFVIGAGVLGALGTGIGGITTSTQFYYKLSQELNGDMERVADSLVTLQDQLNSLAAVVLQNRRALDLLTAERGGTCLFLGEECCYYVNQSGIVTEKVKEIRDRIQRRAEELRNTGPWGLLSQ

SEQ ID NO: 2332 - protein, 248 aa, synthetic construct
  REGION 1..248: note = ESAM (Q96AP7) SP+PP+ECD
MISLPGPLVTNLLRFLFLGLSALAPPSRAQLQLHLPANRLQAVEGGEVVLPAWYTLHGEVSSSQPWEVPFVMWFFKQKEKEDQVLSYINGVTTSKPGVSLVYSMPSRNLSLRLEGLQEKDSGPYSCSVNVQDKQGKSRGHSIKTLELNVLVPPAPPSCRLQGVPHVGANVTLSCQSPRSKPAVQYQWDRQLPSFQTFFAPALDVIRGSLSLTNLSSSMAGVYVCKAHNEVGTAQCNVTLEVSTGPGAA

SEQ ID NO: 2333 - protein, 322 aa, synthetic construct
  REGION 1..322: note = EVA1C (P58658) SP+PP+ECD
MLLPGRARQPPTPQPVQHPGLRRQVEPPGQLLRLFYCTVLVCSKEISALTDFSGYLTKLLQNHTTYACDGDYLNLQCPRHSTISVQSAFYGQDYQMCSSQKPASQREDSLTCVAATTFQKVLDECQNQRACHLLVNSRVFGPDLCPGSSKYLLVSFKCQPNELKNKTVCEDQELKLHCHESKFLNIYSATYGRRTQERDICSSKAERLPPFDCLSYSALQVLSRRCYGKQRCKIIVNNHHFGSPCLPGVKKYLTVTYACVPKNILTAIDPAIANLKPSLKQKDGEYGINFDPSGSKVLRKDGILVSNSLAAFAYIRAHPERA

SEQ ID NO: 2334 - protein, 300 aa, synthetic construct
  REGION 1..300: note = EVC2 (Q86UK5) SP+PP+ECD
MDPSGSRGRPTWVLAGGLLAVALALGGRGCLGASSRPRWRPLGAQPPRDPQVAPRSGPGLRIPPGRSGAGPESSTQDLPCMIWPKVECCHFKTAVEAPLGMKLDKKMEVFIPLSTSAASSGPWAHSLFAFIPSWPKKNLFKRESPITHRLYGDISREVQGTSENGVIFQKCALVSGSSEAQTARIWLLVNNTKTTSSANLSELLLLDSIAGLTIWDSVGNRTSEGFQAFSKKFLQVGDAFAVSYAATLQAGDLGNGESLKLPAQLTFQSSSRNRTQLKVLFSITAEENVTVLPHHGLHAA

SEQ ID NO: 2335 - protein, 133 aa, synthetic construct
  REGION 1..133: note = EVI2A (P22794) SP+PP+ECD
MPTDMEHTGHYLHLAFLMTTVFSLSPGTKANYTRLWANSTSSWDSVIQNKTGRNQNENINTNPITPEVDYKGNSTNMPETSHIVALTSKSEQELYIPSVVSNSPSTVQSIENTSKSHGEIFKKDVCAENNNNM

SEQ ID NO: 2336 - protein, 202 aa, synthetic construct
  REGION 1..202: note = EVI2B (P34910) SP+PP+ECD
MDPKYFILILFCGHLNNTFFSKTETITTEKQSQPTLFTSSMSQVLANSQNTTGNPLGQPTQFSDTFSGQSISPAKVTAGQPTPAVYTSSEKPEAHTSAGQPLAYNTKQPTPIANTSSQQAVFTSARQLPSARTSTTQPPKSFVYTFTQQSSSVQIPSRKQITVHNPSTQPTSTVKNSPRSTPGFILDTTSNKQTPQKNNYNS

SEQ ID NO: 2337 - protein, 238 aa, synthetic construct
  REGION 1..238: note = F11R (Q9Y624) SP+PP+ECD
MGTKAQVERKLLCLFILAILLCSLALGSVTVHSSEPEVRIPENNPVKLSCAYSGFSSPRVEWKFDQGDTTRLVCYNNKITASYEDRVTFLPTGITFKSVTREDTGTYTCMVSEEGGNSYGEVKVKLIVLVPPSKPTVNIPSSATIGNRAVLTCSEQDGSPPSEYTWFKDGIVMPTNPKSTRAFSNSSYVLNPTTGELVFDPLSASDTGEYSCEARNGYGTPMTSNAVRMEAVERNVGV

SEQ ID NO: 2338 - protein, 251 aa, synthetic construct
  REGION 1..251: note = F3 (P13726) SP+PP+ECD
METPAWPRVPRPETAVARTLLLGWVFAQVAGASGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFRE

SEQ ID NO: 2339 - protein, 303 aa, synthetic construct
  REGION 1..303: note = FAM171A1 (Q5VUB5) SP+PP+ECD
MSRSATLLLCLLGCHVWKAVTKTLREPGAGAQEVTLKVHISDASTHQPVADALIEIFTNQASIASGTSGTDGVAFIKFQYKLGSQLIVTASKHAYVPNSAPWKPIRLPVFSSLSLGLLPERSATLMVYEDVVQIVSGFQGARPQPRVHFQRRALRLPENTSYSDLTAFLTAASSPSEVDSFPYLRGLDGNGTGNSTRHDLTPVTAVSVHLLSSNGTPVLVDGPIYVTVPLATQSSLRHNAYVAAWRFDQKLGTWLKSGLGLVHQEGSQLTWTYIAPQLGYWVAAMSPPIPGPVVTQDITTYHT

SEQ ID NO: 2340 - protein, 315 aa, synthetic construct
  REGION 1..315: note = FAM171A2 (A8MVW0) SP+PP+ECD
MPPASGPSVLARLLPLLGLLLGSASRAPGKSPPEPPSPQEILIKVQVYVSGELVPLARASVDVFGNRTLLAAGTTDSEGVATLPLSYRLGTWVLVTAARPGFLTNSVPWRVDKLPLYASVSLYLLPERPATLILYEDLVHILLGSPGARSQPLVQFQRRAARLPVSSTYSQLWASLTPASTQQEMRAFPAFLGTEASSSGNGSWLELMPLTAVSVHLLTGNGTEVPLSGPIHLSLPVPSETRALTVGTSIPAWRFDPKSGLWVRNGTGVIRKEGRQLYWTFVSPQLGYWVAAMASPTAGLVTITSGIQDIGTYHT

SEQ ID NO: 2341 - protein, 353 aa, synthetic construct
  REGION 1..353: note = FAM171B (Q6P995) SP+PP+ECD
MARLCRRVPCTLLLGLAVVLLKARLVPAAARAELSRSDLSLIQQQQQQQQQQQQQQKQLEEAEEERTEVPGATSTLTVPVSVFMLKVQVNDIISRQYLSQAVVEVFVNYTKTNSTVTKSNGAVLIKVPYKLGLSLTIIAYKDGYVLTPLPWKTRRMPIYSSVTLSLFPQSQANIWLFEDTVLITGKLADAKSQPSVQFSKALIKLPDNHHISNVTGYLTVLQQFLKVDNFLHTTGITLNKPGFENIELTPLAAICVKIYSGGKELKVNGSIQVSLPLLRLNDISAGDRIPAWTFDMNTGAWVNHGRGMVKEHNNHLIWTYDAPHLGYWIAAPLPGTRGSGINEDSKDITAYHT

SEQ ID NO: 2342 - protein, 123 aa, synthetic construct
  REGION 1..123: note = FAM174A (Q8TBP5) SP+PP+ECD
MKASQCCCCLSHLLASVLLLLLLPELSGPLAVLLQAAEAAPGLGPPDPRPRTLPPLPPGPTPAQQPGRGLAEAAGPRGSEGGNGSNPVAGLETDDHGGKAGEGSVGGGLAVSPNPGDKPMTQR

SEQ ID NO: 2343 - protein, 90 aa, synthetic construct
  REGION 1..90: note = FAM174B (Q3ZCQ3) SP+PP+ECD
MRAVPLPAPLLPLLLLALLAAPAARASRAESVSAPWPEPERESRPPPGPGPGNTTRFGSGAAGGSGSSSSNSSGDALVTRISILLRDLPT

SEQ ID NO: 2344 - protein, 335 aa, synthetic construct
  REGION 1..335: note = FAM187B (Q17R55) SP+PP+ECD
MPPMLWLLLHFAAPALGFYFSISCPSGKQCQQALLSGNDILLYCNSSGAHWYYLFTQGKKGRLTSLTNISNMEIMPEGSLLIKDPLPSQTGLYHCWNKNGRQVVQYEIDFQDVTTLHITHKDLGQRPLQNETLHLGSKQLIFTWWEPWQDCNRCEEPGECKRLGYRYIEEPLEEAMPCWLYLGEVLVWSSRLRPELQVEACHVQCTNNTQLRVDYVIFDNFRLDEKTEFVWLDCPLGSMYRPVNWRANDTPLTWESQLSGQDFTTFLDPSTGGRQLQVFQPAVYKCFVQQELVAQFKPAASLETLEAQWRENDAQWREARKALRGRADSVLKGLK

SEQ ID NO: 2345 - protein, 173 aa, synthetic construct
  REGION 1..173: note = FAS (P25445) SP+PP+ECD
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHGLEVEINCTRTQNTKCRCKPNFFCNSTVCEHCDPCTKCEHGIIKECTLTSNTKCKEEGSRSN

SEQ ID NO: 2346 - protein, 4181 aa, synthetic construct
  REGION 1..4181: note = FAT1 (Q14517) SP+PP+ECD
MGRHLALLLLLLLLFQHFGDSDGSQRLEQTPLQFTHLEYNVTVQENSAAKTYVGHPVKMGVYITHPAWEVRYKIVSGDSENLFKAEEYILGDFCFLRIRTKGGNTAILNREVKDHYTLIVKALEKNTNVEARTKVRVQVLDTNDLRPLFSPTSYSVSLPENTAIRTSIARVSATDADIGTNGEFYYSFKDRTDMFAIHPTSGVIVLTGRLDYLETKLYEMEILAADRGMKLYGSSGISSMAKLTVHIEQANECAPVITAVTLSPSELDRDPAYAIVTVDDCDQGANGDIASLSIVAGDLLQQFRTVRSFPGSKEYKVKAIGGIDWDSHPFGYNLTLQAKDKGTPPQFSSVKVIHVTSPQFKAGPVKFEKDVYRAEISEFAPPNTPVVMVKAIPAYSHLRYVFKSTPGKAKFSLNYNTGLISILEPVKRQQAAHFELEVTTSDRKASTKVLVKVLGANSNPPEFTQTAYKAAFDENVPIGTTVMSLSAVDPDEGENGYVTYSIANLNHVPFAIDHFTGAVSTSENLDYELMPRVYTLRIRASDWGLPYRREVEVLATITLNNLNDNTPLFEKINCEGTIPRDLGVGEQITTVSAIDADELQLVQYQIEAGNELDFFSLNPNSGVLSLKRSLMDGLGAKVSFHSLRITATDGENFATPLYINITVAASHKLVNLQCEETGVAKMLAEKLLQANKLHNQGEVEDIFFDSHSVNAHIPQFRSTLPTGIQVKENQPVGSSVIFMNSTDLDTGFNGKLVYAVSGGNEDSCFMIDMETGMLKILSPLDRETTDKYTLNITVYDLGIPQKAAWRLLHVVVVDANDNPPEFLQESYFVEVSEDKEVHSEIIQVEATDKDLGPNGHVTYSIVTDTDTFSIDSVTGVVNIARPLDRELQHEHSLKIEARDQAREEPQLFSTVVVKVSLEDVNDNPPTFIPPNYRVKVREDLPEGTVIMWLEAHDPDLGQSGQVRYSLLDHGEGNFDVDKLSGAVRIVQQLDFEKKQVYNLTVRAKDKGKPVSLSSTCYVEVEVVDVNENLHPPVFSSFVEKGTVKEDAPVGSLVMTVSAHDEDARRDGEIRYSIRDGSGVGVFKIGEETGVIETSDRLDRESTSHYWLTVFATDQGVVPLSSFIEIYIEVEDVNDNAPQTSEPVYYPEIMENSPKDVSVVQIEAFDPDSSSNDKLMYKITSGNPQGFFSIHPKTGLITTTSRKLDREQQDEHILEVTVTDNGSPPKSTIARVIVKILDENDNKPQFLQKFYKIRLPEREKPDRERNARREPLYHVIATDKDEGPNAEISYSIEDGNEHGKFFIEPKTGVVSSKRFSAAGEYDILSIKAVDNGRPQKSSTTRLHIEWISKPKPSLEPISFEESFFTFTVMESDPVAHMIGVISVEPPGIPLWFDITGGNYDSHFDVDKGTGTIIVAKPLDAEQKSNYNLTVEATDGTTTILTQVFIKVIDTNDHRPQFSTSKYEVVIPEDTAPETEILQISAVDQDEKNKLIYTLQSSRDPLSLKKFRLDPATGSLYTSEKLDHEAVHQHTLTVMVRDQDVPVKRNFARIVVNVSDTNDHAPWFTASSYKGRVYESAAVGSVVLQVTALDKDKGKNAEVLYSIESGNIGNSFMIDPVLGSIKTAKELDRSNQAEYDLMVKATDKGSPPMSEITSVRIFVTIADNASPKFTSKEYSVELSETVSIGSFVGMVTAHSQSSVVYEIKDGNTGDAFDINPHSGTIITQKALDFETLPIYTLIIQGTNMAGLSTNTTVLVHLQDENDNAPVFMQAEYTGLISESASINSVVLTDRNVPLVIRAADADKDSNALLVYHIVEPSVHTYFAIDSSTGAIHTVLSLDYEETSIFHFTVQVHDMGTPRLFAEYAANVTVHVIDINDCPPVFAKPLYEASLLLPTYKGVKVITVNATDADSSAFSQLIYSITEGNIGEKFSMDYKTGALTVQNTTQLRSRYELTVRASDGRFAGLTSVKINVKESKESHLKFTQDVYSAVVKENSTEAETLAVITAIGNPINEPLFYHILNPDRRFKISRTSGVLSTTGTPFDREQQEAFDVVVEVTEEHKPSAVAHVVVKVIVEDQNDNAPVFVNLPYYAVVKVDTEVGHVIRYVTAVDRDSGRNGEVHYYLKEHHEHFQIGPLGEISLKKQFELDTLNKEYLVTVVAKDGGNPAFSAEVIVPITVMNKAMPVFEKPFYSAEIAESIQVHSPVVHVQANSPEGLKVFYSITDGDPFSQFTINFNTGVINVIAPLDFEAHPAYKLSIRATDSLTGAHAEVFVDIIVDDINDNPPVFAQQSYAVTLSEASVIGTSVVQVRATDSDSEPNRGISYQMFGNHSKSHDHFHVDSSTGLISLLRTLDYEQSRQHTIFVRAVDGGMPTLSSDVIVTVDVTDLNDNPPLFEQQIYEARISEHAPHGHFVTCVKAYDADSSDIDKLQYSILSGNDHKHFVIDSATGIITLSNLHRHALKPFYSLNLSVSDGVFRSSTQVHVTVIGGNLHSPAFLQNEYEVELAENAPLHTLVMEVKTTDGDSGIYGHVTYHIVNDFAKDRFYINERGQIFTLEKLDRETPAEKVISVRLMAKDAGGKVAFCTVNVILTDDNDNAPQFRATKYEVNIGSSAAKGTSVVKVLASDADEGSNADITYAIEADSESVKENLEINKLSGVITTKESLIGLENEFFTFFVRAVDNGSPSKESVVLVYVKILPPEMQLPKFSEPFYTFTVSEDVPIGTEIDLIRAEHSGTVLYSLVKGNTPESNRDESFVIDRQSGRLKLEKSLDHETTKWYQFSILARCTQDDHEMVASVDVSIQVKDANDNSPVFESSPYEAFIVENLPGGSRVIQIRASDADSGTNGQVMYSLDQSQSVEVIESFAINMETGWITTLKELDHEKRDNYQIKVVASDHGEKIQLSSTAIVDVTVTDVNDSPPRFTAEIYKGTVSEDDPQGGVIAILSTTDADSEEINRQVTYFITGGDPLGQFAVETIQNEWKVYVKKPLDREKRDNYLLTITATDGTFSSKAIVEVKVLDANDNSPVCEKTLYSDTIPEDVLPGKLIMQISATDADIRSNAEITYTLLGSGAEKFKLNPDTGELKTSTPLDREEQAVYHLLVRATDGGGRFCQASIVLTLEDVNDNAPEFSADPYAITVFENTEPGTLLTRVQATDADAGLNRKILYSLIDSADGQFSINELSGIIQLEKPLDRELQAVYTLSLKAVDQGLPRRLTATGTVIVSVLDINDNPPVFEYREYGATVSEDILVGTEVLQVYAASRDIEANAEITYSIISGNEHGKFSIDSKTGAVFIIENLDYESSHEYYLTVEATDGGTPSLSDVATVNVNVTDINDNTPVFSQDTYTTVISEDAVLEQSVITVMADDADGPSNSHIHYSIIDGNQGSSFTIDPVRGEVKVTKLLDRETISGYTLTVQASDNGSPPRVNTTTVNIDVSDVNDNAPVFSRGNYSVIIQENKPVGFSVLQLVVTDEDSSHNGPPFFFTIVTGNDEKAFEVNPQGVLLTSSAIKRKEKDHYLLQVKVADNGKPQLSSLTYIDIRVIEESIYPPAILPLEIFITSSGEEYSGGVIGKIHATDQDVYDTLTYSLDPQMDNLFSVSSTGGKLIAHKKLDIGQYLLNVSVTDGKFTTVADITVHIRQVTQEMLNHTIAIRFANLTPEEFVGDYWRNFQRALRNILGVRRNDIQIVSLQSSEPHPHLDVLLFVEKPGSAQISTKQLLHKINSSVTDIEEIIGVRILNVFQKLCAGLDCPWKFCDEKVSVDESVMSTHSTARLSFVTPRHHRAAVCLCKEGRCPPVHHGCEDDPCPEGSECVSDPWEEKHTCVCPSGRFGQCPGSSSMTLTGNSYVKYRLTENENKLEMKLTMRLRTYSTHAVVMYARGTDYSILEIHHGRLQYKFDCGSGPGIVSVQSIQVNDGQWHAVALEVNGNYARLVLDQVHTASGTAPGTLKTLNLDNYVFFGGHIRQQGTRHGRSPQVGNGFRGCMDSIYLNGQELPLNSKPRSYAHIEESVDVSPGCFLTATEDCASNPCQNGGVCNPSPAGGYYCKCSALYIGTHCEISVNPCSSKPCLYGGTCVVDNGGFVCQCRGLYTGQRCQLSPYCKDEPCKNGGTCFDSLDGAVCQCDSGFRGERCQSDIDECSGNPCLHGALCENTHGSYHCNCSHEYRGRHCEDAAPNQYVSTPWNIGLAE

SEQ ID NO: 2347 - protein, 4048 aa, synthetic construct
  REGION 1..4048: note = FAT2 (Q9NYQ8) SP+PP+ECD
MTIALLGFAIFLLHCATCEKPLEGILSSSAWHFTHSHYNATIYENSSPKTYVESFEKMGIYLAEPQWAVRYRIISGDVANVFKTEEYVVGNFCFLRIRTKSSNTALLNREVRDSYTLIIQATEKTLELEALTRVVVHILDQNDLKPLFSPPSYRVTISEDMPLKSPICKVTATDADLGQNAEFYYAFNTRSEMFAIHPTSGVVTVAGKLNVTWRGKHELQVLAVDRMRKISEGNGFGSLAALVVHVEPALRKPPAIASVVVTPPDSNDGTTYATVLVDANSSGAEVESVEVVGGDPGKHFKAIKSYARSNEFSLVSVKDINWMEYLHGFNLSLQARSGSGPYFYSQIRGFHLPPSKLSSLKFEKAVYRVQLSEFSPPGSRVVMVRVTPAFPNLQYVLKPSSENVGFKLNARTGLITTTKLMDFHDRAHYQLHIRTSPGQASTVVVIDIVDCNNHAPLFNRSSYDGTLDENIPPGTSVLAVTATDRDHGENGYVTYSIAGPKALPFSIDPYLGIISTSKPMDYELMKRIYTFRVRASDWGSPFRREKEVSIFLQLRNLNDNQPMFEEVNCTGSIRQDWPVGKSIMTMSAIDVDELQNLKYEIVSGNELEYFDLNHFSGVISLKRPFINLTAGQPTSYSLKITASDGKNYASPTTLNITVVKDPHFEVPVTCDKTGVLTQFTKTILHFIGLQNQESSDEEFTSLSTYQINHYTPQFEDHFPQSIDVLESVPINTPLARLAATDPDAGFNGKLVYVIADGNEEGCFDIELETGLLTVAAPLDYEATNFYILNVTVYDLGTPQKSSWKLLTVNVKDWNDNAPRFPPGGYQLTISEDTEVGTTIAELTTKDADSEDNGRVRYTLLSPTEKFSLHPLTGELVVTGHLDRESEPRYILKVEARDQPSKGHQLFSVTDLIITLEDVNDNSPQCITEHNRLKVPEDLPPGTVLTFLDASDPDLGPAGEVRYVLMDGAHGTFRVDLMTGALILERELDFERRAGYNLSLWASDGGRPLARRTLCHVEVIVLDVNENLHPPHFASFVHQGQVQENSPSGTQVIVVAAQDDDSGLDGELQYFLRAGTGLAAFSINQDTGMIQTLAPLDREFASYYWLTVLAVDRGSVPLSSVTEVYIEVTDANDNPPQMSQAVFYPSIQEDAPVGTSVLQLDAWDPDSSSKGKLTFNITSGNYMGFFMIHPVTGLLSTAQQLDRENKDEHILEVTVLDNGEPSLKSTSRVVVGILDVNDNPPIFSHKLFNVRLPERLSPVSPGPVYRLVASDLDEGLNGRVTYSIEDSDEEAFSIDLVTGVVSSSSTFTAGEYNILTIKATDSGQPPLSASVRLHIEWIPWPRPSSIPLAFDETYYSFTVMETDPVNHMVGVISVEGRPGLFWFNISGGDKDMDFDIEKTTGSIVIARPLDTRRRSNYNLTVEVTDGSRTIATQVHIFMIANINHHRPQFLETRYEVRVPQDTVPGVELLRVQAIDQDKGKSLIYTIHGSQDPGSASLFQLDPSSGVLVTVGKLDLGSGPSQHTLTVMVRDQEIPIKRNFVWVTIHVEDGNLHPPRFTQLHYEASVPDTIAPGTELLQVRAMDADRGVNAEVHYSLLKGNSEGFFNINALLGIITLAQKLDQANHAPHTLTVKAEDQGSPQWHDLATVIIHVYPSDRSAPIFSKSEYFVEIPESIPVGSPILLVSAMSPSEVTYELREGNKDGVFSMNSYSGLISTQKKLDHEKISSYQLKIRGSNMAGAFTDVMVVVDIIDENDNAPMFLKSTFVGQISEAAPLYSMIMDKNNNPFVIHASDSDKEANSLLVYKILEPEALKFFKIDPSMGTLTIVSEMDYESMPSFQFCVYVHDQGSPVLFAPRPAQVIIHVRDVNDSPPRFSEQIYEVAIVGPIHPGMELLMVRASDEDSEVNYSIKTGNADEAVTIHPVTGSISVLNPAFLGLSRKLTIRASDGLYQDTALVKISLTQVLDKSLQFDQDVYWAAVKENLQDRKALVILGAQGNHLNDTLSYFLLNGTDMFHMVQSAGVLQTRGVAFDREQQDTHELAVEVRDNRTPQRVAQGLVRVSIEDVNDNPPKFKHLPYYTIIQDGTEPGDVLFQVSATDEDLGTNGAVTYEFAEDYTYFRIDPYLGDISLKKPFDYQALNKYHLKVIARDGGTPSLQSEEEVLVTVRNKSNPLFQSPYYKVRVPENITLYTPILHTQARSPEGLRLIYNIVEEEPLMLFTTDFKTGVLTVTGPLDYESKTKHVFTVRATDTALGSFSEATVEVLVEDVNDNPPTFSQLVYTTSISEGLPAQTPVIQLLASDQDSGRNRDVSYQIVEDGSDVSKFFQINGSTGEMSTVQELDYEAQQHFHVKVRAMDKGDPPLTGETLVVVNVSDINDNPPEFRQPQYEANVSELATCGHLVLKVQAIDPDSRDTSRLEYLILSGNQDRHFFINSSSGIISMFNLCKKHLDSSYNLRVGASDGVFRATVPVYINTTNANKYSPEFQQHLYEAELAENAMVGTKVIDLLAIDKDSGPYGTIDYTIINKLASEKFSINPNGQIATLQKLDRENSTERVIAIKVMARDGGGRVAFCTVKIILTDENDNPPQFKASEYTVSIQSNVSKDSPVIQVLAYDADEGQNADVTYSVNPEDLVKDVIEINPVTGVVKVKDSLVGLENQTLDFFIKAQDGGPPHWNSLVPVRLQVVPKKVSLPKFSEPLYTFSAPEDLPEGSEIGIVKAVAAQDPVIYSLVRGTTPESNKDGVFSLDPDTGVIKVRKPMDHESTKLYQIDVMAHCLQNTDVVSLVSVNIQVGDVNDNRPVFEADPYKAVLTENMPVGTSVIQVTAIDKDTGRDGQVSYRLSADPGSNVHELFAIDSESGWITTLQELDCETCQTYHFHVVAYDHGQTIQLSSQALVQVSITDENDNAPRFASEEYRGSVVENSEPGELVATLKTLDADISEQNRQVTCYITEGDPLGQFGISQVGDEWRISSRKTLDREHTAKYLLRVTASDGKFQASVTVEIFVLDVNDNSPQCSQLLYTGKVHEDVFPGHFILKVSATDLDTDTNAQITYSLHGPGAHEFKLDPHTGELTTLTALDRERKDVFNLVAKATDGGGRSCQADITLHVEDVNDNAPRFFPSHCAVAVFDNTTVKTPVAVVFARDPDQGANAQVVYSLPDSAEGHFSIDATTGVIRLEKPLQVRPQAPLELTVRASDLGTPIPLSTLGTVTVSVVGLEDYLPVFLNTEHSVQVPEDAPPGTEVLQLATLTRPGAEKTGYRVVSGNEQGRFRLDARTGILYVNASLDFETSPKYFLSIECSRKSSSSLSDVTTVMVNITDVNEHRPQFPQDPYSTRVLENALVGDVILTVSATDEDGPLNSDITYSLIGGNQLGHFTIHPKKGELQVAKALDREQASSYSLKLRATDSGQPPLHEDTDIAIQVADVNDNPPRFFQLNYSTTVQENSPIGSKVLQLILSDPDSPENGPPYSFRITKGNNGSAFRVTPDGWLVTAEGLSRRAQEWYQLQIQASDSGIPPLSSLTSVRVHVTEQSHYAPSALPLEIFITVGEDEFQGGMVGKIHATDRDPQDTLTYSLAEEETLGRHFSVGAPDGKIIAAQGLPRGHYSFNVTVSDGTFTTTAGVHVYVWHVGQEALQQAMWMGFYQLTPEELVSDHWRNLQRFLSHKLDIKRANIHLASLQPAEAVAGVDVLLVFEGHSGTFYEFQELASIITHSAKEMEHSVGVQMRSAMPMVPCQGPTCQGQICHNTVHLDPKVGPTYSTARLSILTPRHHLQRSCSCNGTATRFSGQSYVRYRAPAARNWHIHFYLKTLQPQAILLFTNETASVSLKLASGVPQLEYHCLGGFYGNLSSQRHVNDHEWHSILVEEMDASIRLMVDSMGNTSLVVPENCRGLRPERHLLLGGLILLHSSSNVSQGFEGCLDAVVVNEEALDLLAPGKTVAGLLETQALTQCCLHSDYCSQNTCLNGGKCSWTHGAGYVCKCPPQFSGKHCEQGRENCTFAPCLEGGTCILSPKGASCNCPHPYTGDRCEMEARGCSEGHCLVTPEIQRGDWGQQE

SEQ ID NO: 2348 - protein, 4154 aa, synthetic construct
  REGION 1..4154: note = FAT3 (Q8TDW7) SP+PP+ECD
MDIIMGHCVGTRPPACCLILLLFKLLATVSQGLPGTGPLGFHFTHSIYNATVYENSAARTYVNSQSRMGITLIDLSWDIKYRIVSGDEEGFFKAEEVIIADFCFLRIRTKGGNSAILNREIQDNYLLIVKGSVRGEDLEAWTKVNIQVLDMNDLRPLFSPTTYSVTIAESTPLRTSVAQVTATDADIGSNGEFYYYFKNKVDLFSVHPTSGVISLSGRLNYDEKNRYDLEILAVDRGMKLYGNNGVSSTAKLYVHIERINEHAPTIHVVTHVPFSLEKEPTYAVVTVDDLDDGANGEIESVSIVAGDPLDQFFLAKEGKWLNEYKIKERKQIDWESFPYGYNLTLQAKDKGSPQKCSALKAVYIGNPTRDTVPIRFEKEVYDVSISEFSPPGVVVAIVKLSPEPIDVEYKLSPGEDAVYFKINPRSGLIVTARPLNTVKKEVYKLEVTNKEGDLKAQVTISIEDANDHTPEFQQPLYDAYVNESVPVGTSVLTVSASDKDKGENGYITYSIASLNLLPFVINQFTGVISTTEELDFESSPEIYRFIVRASDWGSPYRHESEVNVTIRIGNVNDNSPLFEKVACQGVISYDFPVGGHITAVSAIDIDELELVKYKIISGNELGFFYLNPDSGVLQLKKSLTNSGIKNGNFALRITATDGENLADPMSINISVLHGKVSSKSFSCRETRVAQKLAEKLLIKAKANGKLNLEDGFLDFYSINRQGPYFDKSFPSDVAVKEDLPVGANILKIKAYDADSGFNGKVLFTISDGNTDSCFNIDMETGQLKVLMPMDREHTDLYLLNITIYDLGNPQKSSWRLLTINVEDANDNSPVFIQDSYSVNILESSGIGTEIIQVEARDKDLGSNGEVTYSVLTDTQQFAINSSTGIVYVADQLDRESKANYSLKIEARDKAESGQQLFSVVTLKVFLDDVNDCSPAFIPSSYSVKVLEDLPVGTVIAWLETHDPDLGLGGQVRYSLVNDYNGRFEIDKASGAIRLSKELDYEKQQFYNLTVRAKDKGRPVSLSSVSFVEVEVVDVNENLHTPYFPDFAVVGSVKENSRIGTSVLQVTARDEDSGRDGEIQYSIRDGSGLGRFSIDDESGVITAADILDRETMGSYWLTVYATDRGVVPLYSTIEVYIEVEDVNDNAPLTSEPIYYPVVMENSPKDVSVIQIQAEDPDSSSNEKLTYRITSGNPQNFFAINIKTGLITTTSRKLDREQQAEHFLEVTVTDGGPSPKQSTIWVVVQVLDENDNKPQFPEKVYQIKLPERDRKKRGEPIYRAFAFDRDEGPNAEISYSIVDGNDDGKFFIDPKTGMVSSRKQFTAGSYDILTIKAVDNGRPQKSSTARLHIEWIKKPPPSPIPLTFDEPFYNFTVMESDRVTEIVGVVSVQPANTPLWFDIVGGNFDSAFDAEKGVGTIVIAKPLDAEQRSIYNMSVEVTDGTNVAVTQVFIKVLDNNDNGPEFSQPNYDVTISEDVLPDTEILQIEATDRDEKHKLSYTVHSSIDSISMRKFRIDPSTGVLYTAERLDHEAQDKHILNIMVRDQEFPYRRNLARVIVNVEDANDHSPYFTNPLYEASVFESAALGSAVLQVTALDKDKGENAELIYTIEAGNTGNMFKIEPVLGIITICKEPDMTTMGQFVLSIKVTDQGSPPMSATAIVRISVTMSDNSHPKFIHKDYQAEVNENVDIGTSVILISAISQSTLIYEVKDGDINGIFTINPYSGVITTQKALDYERTSSYQLIIQATNMAGMASNATVNIQIVDENDNAPVFLFSQYSGSLSEAAPINSIVRSLDNSPLVIRATDADSNRNALLVYQIVESTAKKFFTVDSSTGAIRTIANLDHETIAHFHFHVHVRDSGSPQLTAESPVEVNIEVTDVNDNPPVFTQAVFETILLLPTYVGVEVLKVSATDPDSEVPPELTYSLMEGSLDHFLIDSNSGVLTIKNNNLSKDHYMLIVKVSDGKFYSTSMVTIMVKEAMDSGLHFTQSFYSTSISENNTNITKVAIVNAVGNRLNEPLKYSILNPGNKFKIKSTSGVIQTTGVPFDREEQELYELVVEASRELDHLRVARVVVRVNIEDINDNSPVFVGLPYYAAVQVDAEPGTLIYQVTAIDKDKGPNGEVTYVLQDDYGHFEINPNSGNVILKEAFNSDLSNIEYGVTILAKDGGKPSLSTSVELPITIVNKAMPVFDKPFYTASVNEDIRMNTPILSINATSPEGQGIIYIIIDGDPFKQFNIDFDTGVLKVVSPLDYEVTSAYKLTIRASDALTGARAEVTVDLLVNDVNDNPPIFDQPTYNTTLSEASLIGTPVLQVVSIDADSENNKMVHYQIVQDTYNSTDYFHIDSSSGLILTARMLDHELVQHCTLKVRSIDSGFPSLSSEVLVHIYISDVNDNPPVFNQLIYESYVSELAPRGHFVTCVQASDADSSDFDRLEYSILSGNDRTSFLMDSKSGVITLSNHRKQRMEPLYSLNVSVSDGLFTSTAQVHIRVLGANLYSPAFSQSTYVAEVRENVAAGTKVIHVRATDGDPGTYGQISYAIINDFAKDRFLIDSNGQVITTERLDRENPLEGDVSIFVRALDGGGRTTFCTVRVIVVDENDNAPQFMTVEYRASVRADVGRGHLVTQVQAIDPDDGANSRITYSLYSEASVSVADLLEIDPDNGWMVTKGNFNQLKNTVLSFFVKAVDGGIPVKHSLIPVYIHVLPPETFLPSFTQSQYSFTIAEDTAIGSTVDTLRILPSQNVWFSTVNGERPENNKGGIFVIEQETGTIKLDKRLDRETSPAFHFKVAATIPLDKVDIVFTVDVDIKVLDLNDNKPVFETSSYDTIIMEGMPVGTKLTQVRAIDMDWGANGQVTYSLHSDSQPEKVMEAFNIDSNTGWISTLKDLDHETDPTFTFSVVASDLGEAFSLSSTALVSVRVTDINDNAPVFAQEVYRGNVKESDPPGEVVAVLSTWDRDTSDVNRQVSYHITGGNPRGRFALGLVQSEWKVYVKRPLDREEQDIYFLNITATDGLFVTQAMVEVSVSDVNDNSPVCDQVAYTALLPEDIPSNKIILKVSAKDADIGSNGYIRYSLYGSGNSEFFLDPESGELKTLALLDRERIPVYSLMAKATDGGGRFCQSNIHLILEDVNDNPPVFSSDHYNTCVYENTATKALLTRVQAVDPDIGINRKVVYSLADSAGGVFSIDSSSGIIILEQPLDREQQSSYNISVRATDQSPGQSLSSLTTVTITVLDINDNPPVFERRDYLVTVPEDTSPGTQVLAVFATSKDIGTNAEITYLIRSGNEQGKFKINPKTGGISVSEVLDYELCKRFYLVVEAKDGGTPALSAVATVNINLTDVNDNPPKFSQDVYSAVISEDALVGDSVILLIAEDVDSQPNGQIHFSIVNGDRDNEFTVDPVLGLVKVKKKLDRERVSGYSLLVQAVDSGIPAMSSTATVNIDISDVNDNSPVFTPANYTAVIQENKPVGTSILQLVVTDRDSFHNGPPFSFSILSGNEEEEFVLDPHGILRSAVVFQHTESLEYVLCVQAKDSGKPQQVSHTYIRVRVIEESTHKPTAIPLEIFIVTMEDDFPGGVIGKIHATDQDMYDVLTFALKSEQKSLFKVNSHDGKIIALGGLDSGKYVLNVSVSDGRFQVPIDVVVHVEQLVHEMLQNTVTIRFENVSPEDFVGLHMHGFRRTLRNAVLTQKQDSLRIISIQPVAGTNQLDMLFAVEMHSSEFYKPAYLIQKLSNARRHLENIMRISAILEKNCSGLDCQEQHCEQGLSLDSHALMTYSTARISFVCPRFYRNVRCTCNGGLCPGSNDPCVEKPCPGDMQCVSYEASRRPFLCQCPPGKLGECSGHTSLSFAGNSYIKYRLSENSKEEDFKLALRLRTLQSNGIIMYTRANPCIILKIVDGKLWFQLDCGSGPGILGISGRAVNDGSWHSVFLELNRNFTSLSLDDSYVERRRAPLYFQTLSTESSIYFGALVQADNIRSLTDTRVTQVLSGFQGCLDSVILNNNELPLQNKRSSFAEVVGLTELKLGCVLYPDACKRSPCQHGGSCTGLPSGGYQCTCLSQFTGRNCESEITACFPNPCRNGGSCDPIGNTFICNCKAGLTGVTCEEDINECEREECENGGSCVNVFGSFLCNCTPGYVGQYCGLRPVVVPNIQAGHSYVGKEE

SEQ ID NO: 2349 - protein, 4504 aa, synthetic construct
  REGION 1..4504: note = FAT4 (Q6V0I7) SP+PP+ECD
MDLAPDRATGRPWLPLHTLSVSQLLRVFWLLSLLPGQAWVHGAEPRQVFQVLEEQPPGTLVGTIQTRPGFTYRLSESHALFAINSSTGALYTTSTIDRESLPSDVINLVVLSSAPTYPTEVRVLVRDLNDNAPVFPDPSIVVTFKEDSSSGRQVILDTATDSDIGSNGVDHRSYRIIRGNEAGRFRLDITLNPSGEGAFLHLVSKGGLDREVTPQYQLLVEVEDKGEPKRRGYLQVNVTVQDINDNPPVFGSSHYQAGVPEDAVVGSSVLQVAAADADEGTNADIRYRLQDEGTPFQMDPETGLITVREPLDFEARRQYSLTVQAMDRGVPSLTGRAEALIQLLDVNDNDPVVKFRYFPATSRYASVDENAQVGTVVALLTVTDADSPAANGNISVQILGGNEQRHFEVQSSKVPNLSLIKVASALDRERIPSYNLTVSVSDNYGAPPGAAVQARSSVASLVIFVNDINDHPPVFSQQVYRVNLSEEAPPGSYVSGISATDGDSGLNANLRYSIVSGNGLGWFHISEHSGLVTTGSSGGLDRELASQIVLNISARDQGVHPKVSYAQLVVTLLDVNDEKPVFSQPEGYDVSVVENAPTGTELLMLRATDGDLGDNGTVRFSLQEAETDRRSFRLDPVSGRLSTISSLDREEQAFYSLLVLATDLGSPPQSSMARINVSLLDINDNSPVFYPVQYFAHIKENEPGGSYITTVSATDPDLGTNGTVKYSISAGDRSRFQVNAQSGVISTRMALDREEKTAYQLQIVATDGGNLQSPNQAIVTITVLDTQDNPPVFSQVAYSFVVFENVALGYHVGSVSASTMDLNSNISYLITTGDQKGMFAINQVTGQLTTANVIDREEQSFYQLKVVASGGTVTGDTMVNITVKDLNDNSPHFLQAIESVNVVENWQAGHSIFQAKAVDPDEGVNGMVLYSLKQNPKNLFAINEKNGTISLLGPLDVHAGSYQIEILASDMGVPQLSSSVILTVYVHDVNDNSPVFDQLSYEVTLSESEPVNSRFFKVQASDKDSGANGEIAYTIAEGNTGDAFGIFPDGQLYIKSELDRELQDRYVLMVVASDRAVEPLSATVNVTVILEDVNDNRPLFNSTNYTFYFEEEQRAGSFVGKVSAVDKDFGPNGEVRYSFEMVQPDFELHAISGEITNTHQFDRESLMRRRGTAVFSFTVIATDQGIPQPLKDQATVHVYMKDINDNAPKFLKDFYQATISESAANLTQVLRVSASDVDEGNNGLIHYSIIKGNEERQFAIDSTSGQVTLIGKLDYEATPAYSLVIQAVDSGTIPLNSTCTLNIDILDENDNTPSFPKSTLFVDVLENMRIGELVSSVTATDSDSGDNADLYYSITGTNNHGTFSISPNTGSIFLAKKLDFETQSLYKLNITAKDQGRPPRSSTMSVVIHVRDFNDNPPSFPPGDIFKSIVENIPIGTSVISVTAHDPDADINGQLSYTIIQQMPRGNHFTIDEVKGTIYTNAEIDREFANLFELTVKANDQAVPIETRRYALKNVTILVTDLNDNVPMFISQNALAADPSAVIGSVLTTIMAADPDEGANGEIEYEIINGDTDTFIVDRYSGDLRVASALVPSQLIYNLIVSATDLGPERRKSTTELTIILQGLDGPVFTQPKYITILKEGEPIGTNVISIEAASPRGSEAPVEYYIVSVRCEEKTVGRLFTIGRHTGIIQTAAILDREQGACLYLVDVYAIEKSTAFPRTQRAEVEITLQDINDNPPVFPTDMLDLTVEENIGDGSKIMQLTAMDADEGANALVTYTIISGADDSFRIDPESGDLIATRRLDRERRSKYSLLVRADDGLQSSDMRINITVSDVNDHTPKFSRPVYSFDIPEDTIPGSLVAAILATDDDSGVNGEITYIVNEDDEDGIFFLNPITGVFNLTRLLDYEVQQYYILTVRAEDGGGQFTTIRVYFNILDVNDNPPIFSLNSYSTSLMENLPVGSTVLVFNVTDADDGINSQLTYSIASGDSLGQFTVDKNGVLKVLKALDRESQSFYNLVVQVHDLPQIPASRFTSTAQVSIILLDVNDNPPTFLSPKLTYIPENTPIDTVVFKAQATDPDSGPNSYIEYTLLNPLGNKFSIGTIDGEVRLTGELDREEVSNYTLTVVATDKGQPSLSSSTEVVVMVLDINDNNPIFAQALYKVEINENTLTGTDIIQVFAADGDEGTNGQVRYGIVNGNTNQEFRIDSVTGAITVAKPLDREKTPTYHLTVQATDRGSTPRTDTSTVSIVLLDINDFVPVFELSPYSVNVPENLGTLPRTILQVVARDDDRGSNSKLSYVLFGGNEDNAFTLSASGELGVTQSLDRETKERFVLMITATDSGSPALTGTGTINVIVDDVNDNVPTFASKAYFTTIPEDAPTGTDVLLVNASDADASKNAVIRIIGGNSQFTINPSTGQIITSALLDRETKDNYTLVVVCSDAGSPEPLSSSTSVLVTVTDVNDNPPRFQHHPYVTHIPSPTLPGSFVFAVTVTDADIGPNSELHYSLSGRNSEKFHIDPLRGAIMAAGPLNGASEVTFSVHVKDGGSFPKTDSTTVTVRFVNKADFPKVRAKEQTFMFPENQPVSSLVTTITGSSLRGEPMSYYIASGNLGNTFQIDQLTGQVSISQPLDFEKIQKYVVWIEARDGGFPPFSSYEKLDITVLDVNDNAPIFKEDPFISEILENLSPRKILTVSAMDKDSGPNGQLDYEIVNGNMENSFSINHATGEIRSVRPLDREKVSHYVLTIKSSDKGSPSQSTSVKVMINILDENDNAPRFSQIFSAHVPENSPLGYTVTRVTTSDEDIGINAISRYSIMDASLPFTINPSTGDIVISRPLNREDTDRYRIRVSAHDSGWTVSTDVTIFVTDINDNAPRFSRTSYYLDCPELTEIGSKVTQVFATDPDEGSNGQVFYFIKSQSEYFRINATTGEIFNKQILKYQNVTGFSNVNINRHSFIVTSSDRGKPSLISETTVTINIVDSNDNAPQFLKSKYFTPVTKNVKVGTKLIRVTAIDDKDFGLNSEVEYFISNDNHLGKFKLDNDTGWISVASSLISDLNQNFFITVTAKDKGNPPLSSQATVHITVTEENYHTPEFSQSHMSATIPESHSIGSIVRTVSARDRDAAMNGLIKYSISSGNEEGIFAINSSTGILTLAKALDYELCQKHEMTISAIDGGWVARTGYCSVTVNVIDVNDNSPVFLSDDYFPTVLENAPSGTTVIHLNATDADSGTNAVIAYTVQSSDSDLFVIDPNTGVITTQGFLDFETKQSYHLTVKAFNVPDEERCSFATVNIQLKGTNEYVPRFVSKLYYFEISEAAPKGTIVGEVFASDRDLGTDGEVHYLIFGNSRKKGFQINKKTGQIYVSGILDREKEERVSLKVLAKNFGSIRGADIDEVTVNVTVLDANDPPIFTLNIYSVQISEGVPIGTHVTFVSAFDSDSIPSWSRFSYFIGSGNENGAFSINPQTGQITVTAELDRETLPIYNLSVLAVDSGTPSATGSASLLVTLEDINDNGPMLTVSEGEVMENKRPGTLVMTLQSTDPDLPPNQGPFTYYLLSTGPATSYFSLSTAGVLSTTREIDREQIADFYLSVVTKDSGVPQMSSTGTVHITVIDQNDNPSQSRTVEIFVNYYGNLFPGGILGSVKPQDPDVLDSFHCSLTSGVTSLFSIPGGTCDLNSQPRSTDGTFDLTVLSNDGVHSTVTSNIRVFFAGFSNATVDNSILLRLGVPTVKDFLTNHYLHFLRIASSQLTGLGTAVQLYSAYEENNRTFLLAAVKRNHNQYVNPSGVATFFESIKEILLRQSGVKVESVDHDSCVHGPCQNGGSCLRRLAVSSVLKSRESLPVIIVANEPLQPFLCKCLPGYAGSWCEIDIDECLPSPCHSGGTCHNLVGGFSCSCPDGFTGRACERDINECLQSPCKNGAICQNFPGSFNCVCKTGYTGKMCESSVNYCECNPCFNGGSCQSGVDSYYCHCPFGVFGKHCELNSYGFEELSYMEFPSLDPNNNYIYVKFATIKSHALLLYNYDNQTGDRAEFLALEIAEERLRFSYNLGSGTYKLTTMKKVSDGHFHTVIARRAGMAASLTVDSCSENQEPGYCTVSNVAVSDDWTLDVQPNRVTVGGIRSLEPILQRRGHVESHDFVGCIMEFAVNGRPLEPSQALAAQGILDQCPRLEGACTRSPCQHGGTCMDYWSWQQCHCKEGLTGKYCEKSVTPDTALSLEGKGRLDYHMSQNEKREYLLRQSLRGAMLEPFGVNSLEVKFRTRSENGVLIHIQESSNYTTVKIKNGKVYFTSDAGIAGKVERNIPEVYVADGHWHTFLIGKNGTATVLSVDRIYNRDIIHPTQDFGGLDVLTISLGGIPPNQAHRDAQTAGFDGCIASMWYGGESLPFSGKHSLASISKTDPSVKIGCRGPNICASNPCWGDLLCINQWYAYRCVPPGDCASHPCQNGGSCEPGLHSGFTCSCPDSHTGRTCEMVVACLGVLCPQGKVCKAGSPAGHVCVLSQGPEEISLPLWA

SEQ ID NO: 2350 - protein, 450 aa, synthetic construct
  REGION 1..450: note = FCAMR (Q8WWV6) SP+PP+ECD
MPLFLILCLLQGSSFALPQKRPHPRWLWEGSLPSRTHLRAMGTLRPSSPLCWREESSFAAPNSLKGSRLVSGEPGGAVTIQCHYAPSSVNRHQRKYWCRLGPPRWICQTIVSTNQYTHHRYRDRVALTDFPQRGLFVVRLSQLSPDDIGCYLCGIGSENNMLFLSMNLTISAGPASTLPTATPAAGELTMRSYGTASPVANRWTPGTTQTLGQGTAWDTVASTPGTSKTTASAEGRRTPGATRPAAPGTGSWAEGSVKAPAPIPESPPSKSRSMSNTTEGVWEGTRSSVTNRARASKDRREMTTTKADRPREDIEGVRIALDAAKKVLGTIGPPALVSETLAWEILPQATPVSKQQSQGSIGETTPAAGMWTLGTPAADVWILGTPAADVWTSMEAASGEGSAAGDLDAATGDRGPQATLSQTPAVGPWGPPGKESSVKRTFPEDESSSR

SEQ ID NO: 2351 - protein, 227 aa, synthetic construct
  REGION 1..227: note = FCAR (P24071) SP+PP+ECD
MDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTDSIHQDYTTQN

SEQ ID NO: 2352 - protein, 205 aa, synthetic construct
  REGION 1..205: note = FCER1A (P12319) SP+PP+ECD
MAPAMESPTLLCVALLFFAPDGVLAVPQKPKVSLNPPWNRIFKGENVTLTCNGNNFFEVSSTKWFHNGSLSEETNSSLNIVNAKFEDSGEYKCQHQQVNESEPVYLEVFSDWLLLQASAEVVMEGQPLFLRCHGWRNWDVYKVIYYKDGEALKYWYENHNISITNATVEDSGTYYCTGKVWQLDYESEPLNITVIKAPREKYWLQ

SEQ ID NO: 2353 - protein, 292 aa, synthetic construct
  REGION 1..292: note = FCGR1A (P12314) SP+PP+ECD
MWFLTTLLLWVPVDGQVDTTKAVITLQPPWVSVFQEETVTLHCEVLHLPGSSSTQWFLNGTATQTSTPSYRITSASVNDSGEYRCQRGLSGRSDPIQLEIHRGWLLLQVSSRVFTEGEPLALRCHAWKDKLVYNVLYYRNGKAFKFFHWNSNLTILKTNISHNGTYHCSGMGKHRYTSAGISVTVKELFPAPVLNASVTSPLLEGNLVTLSCETKLLLQRPGLQLYFSFYMGSKTLRGRNTSSEYQILTARREDSGLYWCEAATEDGNVLKRSPELELQVLGLQLPTPVWFH

SEQ ID NO: 2354 - protein, 198 aa, synthetic construct
  REGION 1..198: note = FCGR1B (Q92637) SP+PP+ECD
MWFLTTLLLWVPVDGQVDTTKAVITLQPPWVSVFQEETVTLHCEVLHLPGSSSTQWFLNGTATQTSTPSYRITSASVNDSGEYRCQRGLSGRSDPIQLEIHRGWLLLQVSSRVFMEGEPLALRCHAWKDKLVYNVLYYRNGKAFKFFHWNSNLTILKTNISHNGTYHCSGMGKHRYTSAGISQYTVKGLQLPTPVWFH

SEQ ID NO: 2355 - protein, 217 aa, synthetic construct
  REGION 1..217: note = FCGR2A (P12318) SP+PP+ECD
MTMETQMSQNVCPRNLWLLQPLTVLLLLASADSQAAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSHLDPTFSIPQANHSHSGDYHCTGNIGYTLFSSKPVTITVQVPSMGSSSPMG

SEQ ID NO: 2356 - protein, 217 aa, synthetic construct
  REGION 1..217: note = FCGR2B (P31994) SP+PP+ECD
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAP

SEQ ID NO: 2357 - protein, 223 aa, synthetic construct
  REGION 1..223: note = FCGR2C (P31995) SP+PP+ECD
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMG

SEQ ID NO: 2358 - protein, 208 aa, synthetic construct
  REGION 1..208: note = FCGR3A (P08637) SP+PP+ECD
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQ

SEQ ID NO: 2359 - protein, 297 aa, synthetic construct
  REGION 1..297: note = FCGRT (P55899) SP+PP+ECD
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKEPPSMRLKARPSSPGFSVLTCSAFSFYPPELQLRFLRNGLAAGTGQGDFGPNSDGSFHASSSLTVKSGDEHHYCCIVQHAGLAQPLRVELESPAKSS

SEQ ID NO: 2360 - protein, 307 aa, synthetic construct
  REGION 1..307: note = FCRL1 (Q96LA6) SP+PP+ECD
MLPRLLLLICAPLCEPAELFLIASPSHPTEGSPVTLTCKMPFLQSSDAQFQFCFFRDTRALGPGWSSSPKLQIAAMWKEDTGSYWCEAQTMASKVLRSRRSQINVHRVPVADVSLETQPPGGQVMEGDRLVLICSVAMGTGDITFLWYKGAVGLNLQSKTQRSLTAEYEIPSVRESDAEQYYCVAENGYGPSPSGLVSITVRIPVSRPILMLRAPRAQAAVEDVLELHCEALRGSPPILYWFYHEDITLGSRSAPSGGGASFNLSLTEEHSGNYSCEANNGLGAQRSEAVTLNFTVPTGARSNHLTS

SEQ ID NO: 2361 - protein, 401 aa, synthetic construct
  REGION 1..401: note = FCRL2 (Q96LA5) SP+PP+ECD
MLLWSLLVIFDAVTEQADSLTLVAPSSVFEGDSIVLKCQGEQNWKIQKMAYHKDNKELSVFKKFSDFLIQSAVLSDSGNYFCSTKGQLFLWDKTSNIVKIKVQELFQRPVLTASSFQPIEGGPVSLKCETRLSPQRLDVQLQFCFFRENQVLGSGWSSSPELQISAVWSEDTGSYWCKAETVTHRIRKQSLQSQIHVQRIPISNVSLEIRAPGGQVTEGQKLILLCSVAGGTGNVTFSWYREATGTSMGKKTQRSLSAELEIPAVKESDAGKYYCRADNGHVPIQSKVVNIPVRIPVSRPVLTLRSPGAQAAVGDLLELHCEALRGSPPILYQFYHEDVTLGNSSAPSGGGASFNLSLTAEHSGNYSCEANNGLGAQCSEAVPVSISGPDGYRRDLMTAGV

SEQ ID NO: 2362 - protein, 573 aa, synthetic construct
  REGION 1..573: note = FCRL3 (Q96P31) SP+PP+ECD
MLLWLLLLILTPGREQSGVAPKAVLLLNPPWSTAFKGEKVALICSSISHSLAQGDTYWYHDEKLLKIKHDKIQITEPGNYQCKTRGSSLSDAVHVEFSPDWLILQALHPVFEGDNVILRCQGKDNKNTHQKVYYKDGKQLPNSYNLEKITVNSVSRDNSKYHCTAYRKFYILDIEVTSKPLNIQVQELFLHPVLRASSSTPIEGSPMTLTCETQLSPQRPDVQLQFSLFRDSQTLGLGWSRSPRLQIPAMWTEDSGSYWCEVETVTHSIKKRSLRSQIRVQRVPVSNVNLEIRPTGGQLIEGENMVLICSVAQGSGTVTFSWHKEGRVRSLGRKTQRSLLAELHVLTVKESDAGRYYCAADNVHSPILSTWIRVTVRIPVSHPVLTFRAPRAHTVVGDLLELHCESLRGSPPILYRFYHEDVTLGNSSAPSGGGASFNLSLTAEHSGNYSCDADNGLGAQHSHGVSLRVTVPVSRPVLTLRAPGAQAVVGDLLELHCESLRGSFPILYWFYHEDDTLGNISAHSGGGASFNLSLTTEHSGNYSCEADNGLGAQHSKVVTLNVTGTSRNRTGLT

SEQ ID NO: 2363 - protein, 387 aa, synthetic construct
  REGION 1..387: note = FCRL4 (Q96PJ5) SP+PP+ECD
MLLWASLLAFAPVCGQSAAAHKPVISVHPPWTTFFKGERVTLTCNGFQFYATEKTTWYHRHYWGEKLTLTPGNTLEVRESGLYRCQARGSPRSNPVRLLFSSDSLILQAPYSVFEGDTLVLRCHRRRKEKLTAVKYTWNGNILSISNKSWDLLIPQASSNNNGNYRCIGYGDENDVFRSNFKIIKIQELFPHPELKATDSQPTEGNSVNLSCETQLPPERSDTPLHFNFFRDGEVILSDWSTYPELQLPTVWRENSGSYWCGAETVRGNIHKHSPSLQIHVQRIPVSGVLLETQPSGGQAVEGEMLVLVCSVAEGTGDTTFSWHREDMQESLGRKTQRSLRAELELPAIRQSHAGGYYCTADNSYGPVQSMVLNVTVRETPGNRDGL

SEQ ID NO: 2364 - protein, 851 aa, synthetic construct
  REGION 1..851: note = FCRL5 (Q96RD9) SP+PP+ECD
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPYSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEGAALERRSANSAGGVAISFSLTAEHSGNYYCTADNGFGPQRSKAVSLSVTVPVSHPVLTLSSAEALTFEGATVTLHCEVQRGSPQILYQFYHEDMPLWSSSTPSVGRVSFSFSLTEGHSGNYYCTADNGFGPQRSEVVSLFVTVPVSRPILTLRVPRAQAVVGDLLELHCEAPRGSPPILYWFYHEDVTLGSSSAPSGGEASFNLSLTAEHSGNYSCEANNGLVAQHSDTISLSVIVPVSRPILTFRAPRAQAVVGDLLELHCEALRGSSPILYWFYHEDVTLGKISAPSGGGASFNLSLTTEHSGIYSCEADNGLEAQRSEMVTLKVAVPVSRPVLTLRAPGTHAAVGDLLELHCEALRGSPLILYRFFHEDVTLGNRSSPSGGASLNLSLTAEHSGNYSCEADNGLGAQRSETVTLYITGLTANRSGPFATG

SEQ ID NO: 2365 - protein, 307 aa, synthetic construct
  REGION 1..307: note = FCRL6 (Q6DN72) SP+PP+ECD
MLLWTAVLLFVPCVGKTVWLYLQAWPNPVFEGDALTLRCQGWKNTPLSQVKFYRDGKFLHFSKENQTLSMGAATVQSRGQYSCSGQVMYIPQTFTQTSETAMVQVQELFPPPVLSAIPSPEPREGSLVTLRCQTKLHPLRSALRLLFSFHKDGHTLQDRGPHPELCIPGAKEGDSGLYWCEVAPEGGQVQKQSPQLEVRVQAPVSRPVLTLHHGPADPAVGDMVQLLCEAQRGSPPILYSFYLDEKIVGNHSAPCGGTTSLLFPVKSEQDAGNYSCEAENSVSRERSEPKKLSLKGSQVLFTPASNW

SEQ ID NO: 2366 - protein, 376 aa, synthetic construct
  REGION 1..376: note = FGFR1 (P11362) SP+PP+ECD
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLE

SEQ ID NO: 2367 - protein, 377 aa, synthetic construct
  REGION 1..377: note = FGFR2 (P21802) SP+PP+ECD
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLE

SEQ ID NO: 2368 - protein, 375 aa, synthetic construct
  REGION 1..375: note = FGFR3 (P22607) SP+PP+ECD
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAG

SEQ ID NO: 2369 - protein, 369 aa, synthetic construct
  REGION 1..369: note = FGFR4 (P22455) SP+PP+ECD
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEARYTD

SEQ ID NO: 2370 - protein, 378 aa, synthetic construct
  REGION 1..378: note = FGFRL1 (Q8N441) SP+PP+ECD
MTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKVRSDVKPVIQWLKRVEYGAEGRHNSTIDVGGQKFVVLPTGDVWSRPDGSYLNKLLITRARQDDAGMYICLGANTMGYSFRSAFLTVLPDPKPPGPPVASSSSATSLPWP

SEQ ID NO: 2371 - protein, 524 aa, synthetic construct
  REGION 1..524: note = FLRT1 (Q9NZU1) SP+PP+ECD
MDLRDWLFLCYGLIAFLTEVIDSTTCPSVCRCDNGFIYCNDRGLTSIPADIPDDATTLYLQNNQINNAGIPQDLKTKVNVQVIYLYENDLDEFPINLPRSLRELHLQDNNVRTIARDSLARIPLLEKLHLDDNSVSTVSIEEDAFADSKQLKLLFLSRNHLSSIPSGLPHTLEELRLDDNRISTIPLHAFKGLNSLRRLVLDGNLLANQRIADDTFSRLQNLTELSLVRNSLAAPPLNLPSAHLQKLYLQDNAISHIPYNTLAKMRELERLDLSNNNLTTLPRGLFDDLGNLAQLLLRNNPWFCGCNLMWLRDWVKARAAVVNVRGLMCQGPEKVRGMAIKDITSEMDECFETGPQGGVANAAAKTTASNHASATTPQGSLFTLKAKRPGLRLPDSNIDYPMATGDGAKTLAIHVKALTADSIRITWKATLPASSFRLSWLRLGHSPAVGSITETLVQGDKTEYLLTALEPKSTYIICMVTMETSNAYVADETPVCAKAETADSYGPTTTLNQEQNAGPMASLP

SEQ ID NO: 2372 - protein, 541 aa, synthetic construct
  REGION 1..541: note = FLRT2 (O43155) SP+PP+ECD
MGLQTTKWPSHGAFFLKSWLIISLGLYSQVSKLLACPSVCRCDRNFVYCNERSLTSVPLGIPEGVTVLYLHNNQINNAGFPAELHNVQSVHTVYLYGNQLDEFPMNLPKNVRVLHLQENNIQTISRAALAQLLKLEELHLDDNSISTVGVEDGAFREAISLKLLFLSKNHLSSVPVGLPVDLQELRVDENRIAVISDMAFQNLTSLERLIVDGNLLTNKGIAEGTFSHLTKLKEFSIVRNSLSHPPPDLPGTHLIRLYLQDNQINHIPLTAFSNLRKLERLDISNNQLRMLTQGVFDNLSNLKQLTARNNPWFCDCSIKWVTEWLKYIPSSLNVRGFMCQGPEQVRGMAVRELNMNLLSCPTTTPGLPLFTPAPSTASPTTQPPTLSIPNPSRSYTPPTPTTSKLPTIPDWDGRERVTPPISERIQLSIHFVNDTSIQVSWLSLFTVMAYKLTWVKMGHSLVGGIVQERIVSGEKQHLSLVNLEPRSTYRICLVPLDAFNYRAVEDTICSEATTHASYLNNGSNTASSHEQTTSHSMGSPF

SEQ ID NO: 2373 - protein, 528 aa, synthetic construct
  REGION 1..528: note = FLRT3 (Q9NZU0) SP+PP+ECD
MISAAWSIFLIGTKIGLFLQVAPLSVMAKSCPSVCRCDAGFIYCNDRFLTSIPTGIPEDATTLYLQNNQINNAGIPSDLKNLLKVERIYLYHNSLDEFPTNLPKYVKELHLQENNIRTITYDSLSKIPYLEELHLDDNSVSAVSIEEGAFRDSNYLRLLFLSRNHLSTIPWGLPRTIEELRLDDNRISTISSPSLQGLTSLKRLVLDGNLLNNHGLGDKVFFNLVNLTELSLVRNSLTAAPVNLPGTNLRKLYLQDNHINRVPPNAFSYLRQLYRLDMSNNNLSNLPQGIFDDLDNITQLILRNNPWYCGCKMKWVRDWLQSLPVKVNVRGLMCQAPEKVRGMAIKDLNAELFDCKDSGIVSTIQITTAIPNTVYPAQGQWPAPVTKQPDIKNPKLTKDHQTTGSPSRKTITITVKSVTSDTIHISWKLALPMTALRLSWLKLGHSPAFGSITETIVTGERSEYLVTALEPDSPYKVCMVPMETSNLYLFDETPVCIETETAPLRMYNPTTTLNREQEKEPYKNPNLP

SEQ ID NO: 2374 - protein, 758 aa, synthetic construct
  REGION 1..758: note = FLT1 (P17948) SP+PP+ECD
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLE

SEQ ID NO: 2375 - protein, 543 aa, synthetic construct
  REGION 1..543: note = FLT3 (P36888) SP+PP+ECD
MPALARDGGQLPLLVVFSAMIFGTITNQDLPVIKCVLINHKNNDSSVGKSSSYPMVSESPEDLGCALRPQSSGTVYEAAAVEVDVSASITLQVLVDAPGNISCLWVFKHSSLNCQPHFDLQNRGVVSMVILKMTETQAGEYLLFIQSEATNYTILFTVSIRNTLLYTLRRPYFRKMENQDALVCISESVPEPIVEWVLCDSQGESCKEESPAVVKKEEKVLHELFGTDIRCCARNELGRECTRLFTIDLNQTPQTTLPQLFLKVGEPLWIRCKAVHVNHGFGLTWELENKALEEGNYFEMSTYSTNRTMIRILFAFVSSVARNDTGYYTCSSSKHPSQSALVTIVEKGFINATNSSEDYEIDQYEEFCFSVRFKAYPQIRCTWTFSRKSFPCEQKGLDNGYSISKFCNHKHQPGEYIFHAENDDAQFTKMFTLNIRRKPQVLAEASASQASCFSDGYPLPSWTWKKCSDKSPNCTEEITEGVWNRKANRKVFGQWVSSSTLNMSEAIKGFLVKCCAYNSLGTSCETILLNSPGPFPFIQDNIS

SEQ ID NO: 2376 - protein, 184 aa, synthetic construct
  REGION 1..184: note = FLT3LG (P49771) SP+PP+ECD
MTVLAPAWSPTTYLLLLLLLSSGLSGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQP

SEQ ID NO: 2377 - protein, 775 aa, synthetic construct
  REGION 1..775: note = FLT4 (P35916) SP+PP+ECD
MQRGAALCLRLWLCLGLLDGLVSGYSMTPPTLNITEESHVIDTGDSLSISCRGQHPLEWAWPGAQEAPATGDKDSEDTGVVRDCEGTDARPYCKVLLLHEVHANDTGSYVCYYKYIKARIEGTTAASSYVFVRDFEQPFINKPDTLLVNRKDAMWVPCLVSIPGLNVTLRSQSSVLWPDGQEVVWDDRRGMLVSTPLLHDALYLQCETTWGDQDFLSNPFLVHITGNELYDIQLLPRKSLELLVGEKLVLNCTVWAEFNSGVTFDWDYPGKQAERGKWVPERRSQQTHTELSSILTIHNVSQHDLGSYVCKANNGIQRFRESTEVIVHENPFISVEWLKGPILEATAGDELVKLPVKLAAYPPPEFQWYKDGKALSGRHSPHALVLKEVTEASTGTYTLALWNSAAGLRRNISLELVVNVPPQIHEKEASSPSIYSRHSRQALTCTAYGVPLPLSIQWHWRPWTPCKMFAQRSLRRRQQQDLMPQCRDWRAVTTQDAVNPIESLDTWTEFVEGKNKTVSKLVIQNANVSAMYKCVVSNKVGQDERLIYFYVTTIPDGFTIESKPSEELLEGQPVLLSCQADSYKYEHLRWYRLNLSTLHDAHGNPLLLDCKNVHLFATPLAASLEEVAPGARHATLSLSIPRVAPEHEGHYVCEVQDRRSHDKHCHKKYLSVQALEAPRLTQNLTDLLVNVSDSLEMQCLVAGAHAPSIVWYKDERLLEEKSGVDLADSNQKLSIQRVREEDAGRYLCSVCNAKGCVNSSASVAVEGSEDKGSME

SEQ ID NO: 2378 - protein, 167 aa, synthetic construct
  REGION 1..167: note = FNDC4 (Q9H6D8) SP+PP+ECD
MPSGCHSSPPSGLRGDMASLVPLSPYLSPTVLLLVSCDLGFVRADRPPSPVNVTVTHLRANSATVSWDVPEGNIVIGYSISQQRQNGPGQRVIREVNTTTRACALWGLAEDSDYTVQVRSIGLRGESPPGPRVHFRTLKGSDRLPSNSSSPGDITVEGLDGERPLQT

SEQ ID NO: 2379 - protein, 152 aa, synthetic construct
  REGION 1..152: note = FNDC5 (Q8NAU1) SP+PP+ECD
MHPGSPSAWPPRARAALRLWLGCVCFALVQADSPSAPVNVTVRHLKANSAVVSWDVLEDEVVIGFAISQQKKDVRMLRFIQEVNTTTRSCALWDLEEDTEYIVHVQAISIQGQSPASEPVLFKTPREAEKMASKNKDEVTMKEMGRNQQLRT

SEQ ID NO: 2380 - protein, 3901 aa, synthetic construct
  REGION 1..3901: note = FRAS1 (Q86XX4) SP+PP+ECD
MGVLKVWLGLALALAEFAVLPHHSEGACVYQDSLLADATIWKPDSCQSCRCHGDIVICKPAVCRNPQCAFEKGEVLQIAANQCCPECVLRTPGSCHHEKKIHEHGTEWASSPCSVCSCNHGEVRCTPQPCPPLSCGHQELAFIPEGSCCPVCVGLGKPCSYEGHVFQDGEDWRLSRCAKCLCRNGVAQCFTAQCQPLFCNQDETVVRVPGKCCPQCSARSCSAAGQVYEHGEQWSENACTTCICDRGEVRCHKQACLPLRCGKGQSRARRHGQCCEECVSPAGSCSYDGVVRYQDEMWKGSACEFCMCDHGQVTCQTGECAKVECARDEELIHLDGKCCPECISRNGYCVYEETGEFMSSNASEVKRIPEGEKWEDGPCKVCECRGAQVTCYEPSCPPCPVGTLALEVKGQCCPDCTSVHCHPDCLTCSQSPDHCDLCQDPTKLLQNGWCVHSCGLGFYQAGSLCLACQPQCSTCTSGLECSSCQPPLLMRHGQCVPTCGDGFYQDRHSCAVCHESCAGCWGPTEKHCLACRDPLHVLRDGGCESSCGKGFYNRQGTCSACDQSCDSCGPSSPRCLTCTEKTVLHDGKCMSECPGGYYADATGRCKVCHNSCASCSGPTPSHCTACSPPKALRQGHCLPRCGEGFYSDHGVCKACHSSCLACMGPAPSHCTGCKKPEEGLQVEQLSDVGIPSGECLAQCRAHFYLESTGICEACHQSCFRCAGKSPHNCTDCGPSHVLLDGQCLSQCPDGYFHQEGSCTECHPTCRQCHGPLESDCISCYPHISLTNGNCRTSCREEQFLNLVGYCADCHHLCQHCAADLHNTGSICLRCQNAHYLLLGDHCVPDCPSGYYAERGACKKCHSSCRTCQGRGPFSCSSCDTNLVLSHTGTCSTTCFPGHYLDDNHVCQPCNTHCGSCDSQASCTSCRDPNKVLLFGECQYESCAPQYYLDFSTNTCKECDWSCSACSGPLKTDCLQCMDGYVLQDGACVEQCLSSFYQDSGLCKNCDSYCLQCQGPHECTRCKGPFLLLEAQCVQECGKGYFADHAKHKCTACPQGCLQCSHRDRCHLCDHGFFLKSGLCVYNCVPGFSVHTSNETCSGKIHTPSLHVNGSLILPIGSIKPLDFSLLNVQDQEGRVEDLLFHVVSTPTNGQLVLSRNGKEVQLDKAGRFSWKDVNEKKVRFVHSKEKLRKGYLFLKISDQQFFSEPQLINIQAFSTQAPYVLRNEVLHISRGERATITTQMLDIRDDDNPQDVVIEIIDPPLHGQLLQTLQSPATPIYQFQLDELSRGLLHYAHDGSDSTSDVAVLQANDGHSFHNILFQVKTVPQNDRGLQLVANSMVWVPEGGMLQITNRILQAEAPGASAEEIIYKITQDYPQFGEVVLLVNMPADSPADEGQHLPDGRTATPTSTFTQQDINEGIVWYRHSGAPAQSDSFRFEVSSASNAQTRLESHMFNIAILPQTPEAPKVSLEASLHMTAREDGLTVIQPHSLSFINSEKPSGKIVYNITLPLHPNQGIIEHRDHPHSPIRYFTQEDINQGKVMYRPPPAAPHLQELMAFSFAGLPESVKFHFTVSDGEHTSPEMVLTIHLLPSDQQLPVFQVTAPRLAVSPGGSTSVGLQVVVRDAETAPKELFFELRRPPQHGVLLKHTAEFRRPMATGDTFTYEDVEKNALQYIHDGSSTREDSMEISVTDGLTVTMLEVRVEVSLSEDRGPRLAAGSSLSITVASKSTAIITRSHLAYVDDSSPDPEIWIQLNYLPSYGTLLRISGSEVEELSEVSNFTMEDINNKKIRYSAVFETDGHLVTDSFYFSVSDMDHNHLDNQIFTIMITPAENPPPVIAFADLITVDEGGRAPLSFHHFFATDDDDNLQRDAIIKLSALPKYGCIENTGTGDRFGPETASDLEASFPIQDVLENYIYYFQSVHESIEPTHDIFSFYVSDGTSRSEIHSINITIERKNDEPPRMTLQPLRVQLSSGVVISNSSLSLQDLDTPDNELIFVLTKKPDHGHVLWRQTASEPLENGRVLVQGSTFTYQDILAGLVGYVPSVPGMVVDEFQFSLTDGLHVDTGRMKIYTELPASDTPHLAINQGLQLSAGSVARITEQHLKVTDIDSDDHQVMYIMKEDPGAGRLQMMKHGNLEQISIKGPIRSFTQADISQGQPEYSHGTGEPGGSFAFKFDVVDGEGNRLIDKSFSISISEDKSPPVITTNKGLVLDENSVKKITTLQLSATDQDSGPTELIYRITRQPQLGHLEHAASPGIQISSFTQADLTSRNVQYVHSSEAEKHSDAFSFTLSDGVSEVTQTFHITLHPVDDSLPVVQNLGMRVQEGMRKTITEFELKAVDADTEAESVTFTIVQPPRHGTIERTSNGQHFHLTSTFTMKDIYQNRVSYSHDGSNSLKDRFTFTVSDGTNPFFIIEEGGKEIMTAAPQPFRVDILPVDDGTPRIVTNLGLQWLEYMDGKATNLITKKELLTMDPDTEDAQLVYEITTGPKHGFVENKLQPGRAAATFTQEDVNLGLIRYVLHKEKIREMMDSFQFLVKDSKPNVVSDNVFHIQWSLISFKYTSYNVSEKAGSVSVTVQRTGNLNQYAIVLCRTEQGTASSSSQPGQQDYVEYAGQVQFDEREDTKSCTIVINDDDVFENVESFTVELSMPAYALLGEFTQAKVIINDTEDEPTLEFDKKIYWVNESAGFLFAPIERKGDASSIVSAICYTVPKSAMGSLFYALESGSDFKSRGMSAASRVIFGPGVTMSTCDVMLIDDSEYEEEEEFEIALADASDNARIGRVATAKVLISGPNDASTVSLGNTAFTVSEDAGTVKIPVIRHGTDLSTFASVWCATRPSDPASATPGVDYVPSSRKVEFGPGVIEQYCTLTILDDTQYPVIEGLETFVVFLSSAQGAELTKPFQAVIAINDTFQDVPSMQFAKDLLLVKEKEGVLHVPITRSGDLSYESSVRCYTQSHSAQVMEDFEERQNADSSRITFLKGDKVKNCTVYIHDDSMFEPEEQFRVYLGLPLGNHWSGARIGKNNMATITISNDEDAPTIEFEEAAYQVREPAGPDAIAILNIKVIRRGDQNRTSKVRCSTRDGSAQSGVDYYPKSRVLKFSPGVDHIFFKVEILSNEDREWHESFSLVLGPDDPVEAVLGDVTTATVTILDQEAAGSLILPAPPIVVTLADYDHVEEVTKEGVKKSPSPGYPLVCVTPCDPHFPRYAVMKERCSEAGINQTSVQFSWEVAAPTDGNGARSPFETITDNTPFTSVNHMVLDSIYFSRRFHVRCVAKAVDKVGHVGTPLRSNIVTIGTDSAICHTPVVAGTSRGFQAQSFIATLKYLDVKHKEHPNRIHISVQIPHQDGMLPLISTMPLHNLHFLLSESIYRHQHVCSNLVTTYDLRGLAEAGFLDDVVYDSTALGPGYDRPFQFDPSVREPKTIQLYKHLNLKSCVWTFDAYYDMTELIDVCGGSVTADFQVRDSAQSFLTVHVPLYVSYIYVTAPRGWASLEHHTEMEFSFFYDTVLWRTGIQTDSVLSARLQIIRIYIREDGRLVIEFKTHAKFRGQFVMEHHTLPEVKSFVLTPDHLGGIEFDLQLLWSAQTFDSPHQLWRATSSYNRKDYSGEYTIYLIPCTVQPTQPWVDPGEKPLACTAHAPERFLIPIAFQQTNRPVPVVYSLNTEFQLCNNEKVFLMDPNTSDMSLAEMDYKGAFSKGQILYGRVLWNPEQNLNSAYKLQLEKVYLCTGKDGYVPFFDPTGTIYNEGPQYGCIQPNKHLKHRFLLLDRNQPEVTDKYFHDVPFEAHFASELPDFHVVSNMPGVDGFTLKVDALYKVEAGHQWYLQVIYIIGPDTISGPRVQRSLTAPLRRNRRDLVEPDGQLILDDSLIYDNEGDQVKNGTNMKSLNLEMQELAVAASLSQTGAS

SEQ ID NO: 2381 - protein, 3113 aa, synthetic construct
  REGION 1..3113: note = FREM2 (Q5SZK8) SP+PP+ECD
MHSAGTPGLSSRRTGNSTSFQPGPPPPPRLLLLLLLLLSLVSRVPAQPAAFGRALLSPGLAGAAGVPAEEAIVLANRGLRVPFGREVWLDPLHDLVLQVQPGDRCAVSVLDNDALAQRPGRLSPKRFPCDFGPGEVRYSHLGARSPSRDRVRLQLRYDAPGGAVVLPLVLEVEVVFTQLEVVTRNLPLVVEELLGTSNALDARSLEFAFQPETEECRVGILSGLGALPRYGELLHYPQVPGGAREGGAPETLLMDCKAFQELGVRYRHTAASRSPNRDWIPMVVELRSRGAPVGSPALKREHFQVLVRIRGGAENTAPKPSFVAMMMMEVDQFVLTALTPDMLAAEDAESPSDLLIFNLTSPFQPGQGYLVSTDDRSLPLSSFTQRDLRLLKIAYQPPSEDSDQERLFELELEVVDLEGAASDPFAFMVVVKPMNTMAPVVTRNTGLILYEGQSRPLTGPAGSGPQNLVISDEDDLEAVRLEVVAGLRHGHLVILGASSGSSAPKSFTVAELAAGQVVYQHDDRDGSLSDNLVLRMVDGGGRHQVQFLFPITLVPVDDQPPVLNANTGLTLAEGETVPILPLSLSATDMDSDDSLLLFVLESPFLTTGHLLLRQTHPPHEKQELLRGLWRKEGAFYERTVTEWQQQDITEGRLFYRHSGPHSPGPVTDQFTFRVQDNHDPPNQSGLQRFVIRIHPVDRLPPELGSGCPLRMVVQESQLTPLRKKWLRYTDLDTDDRELRYTVTQSPTDTDENHLPAPLGTLVLTDNPSVVVTHFTQAQINHHKIAYRPPGQELGVATRVAQFQFQVEDRAGNVAPGTFTLYLHPVDNQPPEILNTGFTIQEKGHHILSETELHVNDVDTDVAHISFTLTQAPKHGHMRVSGQILHVGGLFHLEDIKQGRVSYAHNGDKSLTDSCSLEVSDRHHVVPITLRVNVRPVDDEVPILSHPTGTLESYLDVLENGATEITANVIKGTNEETDDLMLTFLLEDPPLYGEILVNGIPAEQFTQRDILEGSVVYTHTSGEIGLLPKADSFNLSLSDMSQEWRIGGNTIQGVTIWVTILPVDSQAPEIFVGEQLIVMEGDKSVITSVHISAEDVDSLNDDILCTIVIQPTSGYVENISPAPGSEKSRAGIAISAFNLKDLRQGHINYVQSVHKGVEPVEDRFVFRCSDGINFSERQFFPIVIIPTNDEQPEMFMREFMVMEGMSLVIDTPILNAADADVPLDDLTFTITQFPTHGHIMNQLINGTVLVESFTLDQIIESSSIIYEHDDSETQEDSFVIKLTDGKHSVEKTVLIIVIPVDDETPRMTINNGLEIEIGDTKIINNKILMATDLDSEDKSLVYIIRYGPGHGLLQRRKPTGAFENITLGMNFTQDEVDRNLIQYVHLGQEGIRDLIKFDVTDGINPLIDRYFYVSIGSIDIVFPDVISKGVSLKEGGKVTLTTDLLSTSDLNSPDENLVFTITRAPMRGHLECTDQPGVSITSFTQLQLAGNKIYYIHTADDEVKMDSFEFQVTDGRNPVFRTFRISISDVDNKKPVVTIHKLVVSESENKLITPFELTVEDRDTPDKLLKFTITQVPIHGHLLFNNTRPVMVFTKQDLNENLISYKHDGTESSEDSFSFTVTDGTHTDFYVFPDTVFETRRPQVMKIQVLAVDNSVPQIAVNKGASTLRTLATGHLGFMITSKILKVEDRDSLHISLRFIVTEAPQHGYLLNLDKGNHSITQFTQADIDDMKICYVLREGANATSDMFYFAVEDGGGNKLTYQNFRLNWAWISFEKEYYLVNEDSKFLDVVLKRRGYLGETSFISIGTRDRTAEKDKDFKGKAQKQVQFNPGQTRATWRVRILSDGEHEQSETFQVVLSEPVLAALEFPTVATVEIVDPGDEPTVFIPQSKYSVEEDVGELFIPIRRSGDVSQELMVVCYTQQGTATGTVPTSVLSYSDYISRPEDHTSVVRFDKDEREKLCRIVIIDDSLYEEEETFHVLLSMPMGGRIGSEFPGAQVTIVPDKDDEPIFYFGDVEYSVDESAGYVEVQVWRTGTDLSKSSSVTVRSRKTDPPSADAGTDYVGISRNLDFAPGVNMQPVRVVILDDLGQPALEGIEKFELVLRMPMNAALGEPSKATVSINDSVSDLPKMQFKERIYTGSESDGQIVTMIHRTGDVQYRSSVRCYTRQGSAQVMMDFEERPNTDTSIITFLPGETEKPCILELMDDVLYEEVEELRLVLGTPQSNSPFGAAVGEQNETLIRIRDDADKTVIKFGETKFSVTEPKEPGESVVIRIPVIRQGDTSKVSIVRVHTKDGSATSGEDYHPVSEEIEFKEGETQHVVEIEVTFDGVREMREAFTVHLKPDENMIAEMQLTKAIVYIEEMSSMADVTFPSVPQIVSLLMYDDTSKAKESAEPMSGYPVICITACNPKYSDYDKTGSICASENINDTLTRYRWLISAPAGPDGVTSPMREVDFDTFFTSSKMVTLDSIYFQPGSRVQCAARAVNTNGDEGLELMSPIVTISREEGLCQPRVPGVVGAEPFSAKLRYTGPEDADYTNLIKLTVTMPHIDGMLPVISTRELSNFELTLSPDGTRVGNHKCSNLLDYTEVKTHYGFLTDATKNPEIIGETYPYQYSLSIRGSTTLRFYRNLNLEACLWEFVSYYDMSELLADCGGTIGTDGQVLNLVQSYVTLRVPLYVSYVFHSPVGVGGWQHFDLKSELRLTFVYDTAILWNDGIGSPPEAELQGSLYPTSMRIGDEGRLAVHFKTEAQFHGLFVLSHPASFTSSVIMSADHPGLTFSLRLIRSEPTYNQPVQQWSFVSDFAVRDYSGTYTVKLVPCTAPSHQEYRLPVTCNPREPVTFDLDIRFQQVSDPVAAEFSLNTQMYLLSKKSLWLSDGSMGFGQESDVAFAEGDIIYGRVMVDPVQNLGDSFYCSIEKVFLCTGADGYVPKYSPMNAEYGCLADSPSLLYRFKIVDKAQPETQATSFGNVLFNAKLAVDDPEAILLVNQPGSDGFKVDSTPLFQVALGREWYIHTIYTVRSKDNANRGIGKRSVEYHSLVSQGKPQSTTKSRKKREIRSTPSLAWEIGAENSRGTNIQHIALDRTKRQIPHGRAPPDGILPWELNSPSSAVSLVT

SEQ ID NO: 2382 - protein, 715 aa, synthetic construct
  REGION 1..715: note = FURIN (P09958) SP+PP+ECD
MELRPWLLWVVAATGTLVLLAADAQGQKVFTNTWAVRIPGGPAVANSVARKHGFLNLGQIFGDYYHFWHRGVTKRSLSPHRPRHSRLQREPQVQWLEQQVAKRRTKRDVYQEPTDPKFPQQWYLSGVTQRDLNVKAAWAQGYTGHGIVVSILDDGIEKNHPDLAGNYDPGASFDVNDQDPDPQPRYTQMNDNRHGTRCAGEVAAVANNGVCGVGVAYNARIGGVRMLDGEVTDAVEARSLGLNPNHIHIYSASWGPEDDGKTVDGPARLAEEAFFRGVSQGRGGLGSIFVWASGNGGREHDSCNCDGYTNSIYTLSISSATQFGNVPWYSEACSSTLATTYSSGNQNEKQIVTTDLRQKCTESHTGTSASAPLAAGIIALTLEANKNLTWRDMQHLVVQTSKPAHLNANDWATNGVGRKVSHSYGYGLLDAGAMVALAQNWTTVAPQRKCIIDILTEPKDIGKRLEVRKTVTACLGEPNHITRLEHAQARLTLSYNRRGDLAIHLVSPMGTRSTLLAARPHDYSADGFNDWAFMTTHSWDEDPSGEWVLEIENTSEANNYGTLTKFTLVLYGTAPEGLPVPPESSGCKTLTSSQACVVCEEGFSLHQKSCVQHCPPGFAPQVLDTHYSTENDVETIRASVCAPCHASCATCQGPALTDCLSCPSHASLDPVEQTCSRQSQSSRESPPQQQPPRLPPEVEAGQRLRAGLLPSHLPE

SEQ ID NO: 2383 - protein, 142 aa, synthetic construct
  REGION 1..142: note = G6B (O95866) SP+PP+ECD
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHGSVYPQ

SEQ ID NO: 2384 - protein, 351 aa, synthetic construct
  REGION 1..351: note = GFRAL (Q6UXV0) SP+PP+ECD
MIVFIFLAMGLSLENEYTSQTNNCTYLREQCLRDANGCKHAWRVMEDACNDSDPGDPCKMRNSSYCNLSIQYLVESNFQFKECLCTDDFYCTVNKLLGKKCINKSDNVKEDKFKWNLTTRSHHGFKGMWSCLEVAEACVGDVVCNAQLASYLKACSANGNPCDLKQCQAAIRFFYQNIPFNIAQMLAFCDCAQSDIPCQQSKEALHSKTCAVNMVPPPTCLSVIRSCQNDELCRRHYRTFQSKCWQRVTRKCHEDENCISTLSKQDLTCSGSDDCKAAYIDILGTVLQVQCTCRTITQSEESLCKIFQHMLHRKSCFNYPTLSNVKGMALYTRKHANKITLTGFHSPFNGE

SEQ ID NO: 2385 - protein, 409 aa, synthetic construct
  REGION 1..409: note = GFY (I3L273) SP+PP+ECD
MKSFSRILFLVFLLAGLRSKAAPSAPLPLGCGFPDMAHPSETSPLKGASENSKRDRLNPEFPGTPYPEPSKLPHTVSLETFPLDFTEPLNPDLRETPHPESPETPKADSLTTSISESLDMPKTNLSKMAHPESSETPTPGPTEMPHPGSPETPKPNFSKTSRPEFPETPNTDLMQTTPQESPEILQLNATEVSQAELPETSNTNPTKTPDPKSPEKHDLNSTETPNSEFLQALHPDPSKTPHPESHVTHNPSPTEISQTEFPTTYYQNATDVPRTSDPQISTSLYPETPVPFKDDATALNELSLNPKPGTPAAIQPDSPKLPTSDSPGMVELKAPQNSGPKESNVPPPSARIAGPPALPGRPSQLAPATLRAPQRHSRGEGVNTIIVVERVKETGVTLVGRPRGAAGGA

SEQ ID NO: 2386 - protein, 264 aa, synthetic construct
  REGION 1..264: note = GHR (P10912) SP+PP+ECD
MDLWQLLLTLALAGSSDAFSGSEATAAILSRAPWSLQSVNPGLKTNSSKEPKFTKCRSPERETFSCHWTDEVHHGTKNLGPIQLFYTRRNTQEWTQEWKECPDYVSAGENSCYFNSSFTSIWIPYCIKLTSNGGTVDEKCFSVDEIVQPDPPIALNWTLLNVSLTGIHADIQVRWEAPRNADIQKGWMVLEYELQYKEVNETKWKMMDPILTTSVPVYSLKVDKEYEVRVRSKQRNSGNYGEFSEVLYVTLPQMSQFTCEEDFY

SEQ ID NO: 2387 - protein, 268 aa, synthetic construct
  REGION 1..268: note = GINM1 (Q9NU53) SP+PP+ECD
MEGAPPGSLALRLLLFVALPASGWLTTGAPEPPPLSGAPQDGIRINVTTLKDDGDISKQQVVLNITYESGQVYVNDLPVNSGVTRISCQTLIVKNENLENLEEKEYFGIVSVRILVHEWPMTSGSSLQLIVIQEEVVEIDGKQVQQKDVTEIDILVKNRGVLRHSNYTLPLEESMLYSISRDSDILFTLPNLSKKESVSSLQTTSQYLIRNVETTVDEDVLPGKLPETPLRAEPPSSYKVMCQWMEKFRKDLCRFWSNVFPVFFQFLN

SEQ ID NO: 2388 - protein, 232 aa, synthetic construct
  REGION 1..232: note = GLIPR1 (P48060) SP+PP+ECD
MRVTLATIAWMVSFVSNYSHTANILPDIENEDFIKDCVRIHNKFRSEVKPTASDMLYMTWDPALAQIAKAWASNCQFSHNTRLKPPHKLHPNFTSLGENIWTGSVPIFSVSSAITNWYDEIQDYDFKTRICKKVCGHYTQVVWADSYKVGCAVQFCPKVSGFDALSNGAHFICNYGPGGNYPTWPYKRGATCSACPNNDKCLDNLCVNRQRDQVKRYYSVVYPGWPIYPRNR

SEQ ID NO: 2389 - protein, 531 aa, synthetic construct
  REGION 1..531: note = GP1BA (P07359) SP+PP+ECD
MPLLLLLLLLPSPLHPHPICEVSKVASHLEVNCDKRNLTALPPDLPKDTTILHLSENLLYTFSLATLMPYTRLTQLNLDRCELTKLQVDGTLPVLGTLDLSHNQLQSLPLLGQTLPALTVLDVSFNRLTSLPLGALRGLGELQELYLKGNELKTLPPGLLTPTPKLEKLSLANNNLTELPAGLLNGLENLDTLLLQENSLYTIPKGFFGSHLLPFAFLHGNPWLCNCEILYFRRWLQDNAENVYVWKQGVDVKAMTSNVASVQCDNSDKFPVYKYPGKGCPTLGDEGDTDLYDYYPEEDTEGDKVRATRTVVKFPTKAHTTPWGLFYSWSTASLDSQMPSSLHPTQESTKEQTTFPPRWTPNFTLHMESITFSKTPKSTTEPTPSPTTSEPVPEPAPNMTTLEPTPSPTTPEPTSEPAPSPTTPEPTSEPAPSPTTPEPTSEPAPSPTTPEPTPIPTIATSPTILVSATSLITPKSTFLTTTKPVSLLESTKKTIPELDQPPKLRGVLQGHLESSRNDPFLHPDFCCLLPL

SEQ ID NO: 2390 - protein, 147 aa, synthetic construct
  REGION 1..147: note = GP1BB (P13224) SP+PP+ECD
MGSGPRGALSLLLLLLAPPSRPAAGCPAPCSCAGTLVDCGRRGLTWASLPTAFPVDTTELVLTGNNLTALPPGLLDALPALRTAHLGANPWRCDCRLVPLRAWLAGRPERAPYRDLRCVAPPALRGRLLPYLAEDELRAACAPGPLC

SEQ ID NO: 2391 - protein, 523 aa, synthetic construct
  REGION 1..523: note = GP5 (P40197) SP+PP+ECD
MLRGTLLCAVLGLLRAQPFPCPPACKCVFRDAAQCSGGDVARISALGLPTNLTHILLFGMGRGVLQSQSFSGMTVLQRLMISDSHISAVAPGTFSDLIKLKTLRLSRNKITHLPGALLDKMVLLEQLFLDHNALRGIDQNMFQKLVNLQELALNQNQLDFLPASLFTNLENLKLLDLSGNNLTHLPKGLLGAQAKLERLLLHSNRLVSLDSGLLNSLGALTELQFHRNHIRSIAPGAFDRLPNLSSLTLSRNHLAFLPSALFLHSHNLTLLTLFENPLAELPGVLFGEMGGLQELWLNRTQLRTLPAAAFRNLSRLRYLGVTLSPRLSALPQGAFQGLGELQVLALHSNGLTALPDGLLRGLGKLRQVSLRRNRLRALPRALFRNLSSLESVQLDHNQLETLPGDVFGALPRLTEVLLGHNSWRCDCGLGPFLGWLRQHLGLVGGEEPPRCAGPGAHAGLPLWALPGGDAECPGPRGPPPRPAADSSSEAPVHPALAPNSSEPWVWAQPVTTGKGQDHSPFWG

SEQ ID NO: 2392 - protein, 267 aa, synthetic construct
  REGION 1..267: note = GP6 (Q9HCN6) SP+PP+ECD
MSPSPTALFCLGLCLGRVPAQSGPLPKPSLQALPSSLVPLEKPVTLRCQGPPGVDLYRLEKLSSSRYQDQAVLFIPAMKRSLAGRYRCSYQNGSLWSLPSDQLELVATGVFAKPSLSAQPGPAVSSGGDVTLQCQTRYGFDQFALYKEGDPAPYKNPERWYRASFPIITVTAAHSGTYRCYSFSSRDPYLWSAPSDPLELVVTGTSVTPSRLPTEPPSPVAEFSEATAELTVSFTNEVFTTETSRSITASPKESDSPAGPARQYYTK

SEQ ID NO: 2393 - protein, 235 aa, synthetic construct
  REGION 1..235: note = GPA33 (Q99795) SP+PP+ECD
MVGKMWPVLWTLCAVRVTVDAISVETPQDVLRASQGKSVTLPCTYHTSTSSREGLIQWDKLLLTHTERVVIWPFSNKNYIHGELYKNRVSISNNAEQSDASITIDQLTMADNGTYECSVSLMSDLEGNTKSRVRLLVLVPPSKPECGIEGETIIGNNIQLTCQSKEGSPTPQYSWKRYNILNQEQPLAQPASGQPVSLKNISTDTSGYYICTSSNEEGTQFCNITVAVRSPSMNV

SEQ ID NO: 2394 - protein, 498 aa, synthetic construct
  REGION 1..498: note = GPNMB (Q14956) SP+PP+ECD
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLATTLKSYDSNTPGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMAN

SEQ ID NO: 2395 - protein, 430 aa, synthetic construct
  REGION 1..430: note = GUCY2C (P25092) SP+PP+ECD
MKTLLLDLALWSLLFQPGWLSFSSQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQ

SEQ ID NO: 2396 - protein, 91 aa, synthetic construct
  REGION 1..91: note = GYPA (P02724) SP+PP+ECD
MYGKIIFVLLLSEIVSISASSTTGVAMHTSTSSSVTKSYISSQTNDTHKRDTYAATPRAHEVSEISVRTVYPPEEETGERVQLAHHFSEPE

SEQ ID NO: 2397 - protein, 295 aa, synthetic construct
  REGION 1..295: note = HAVCR1 (Q96D42) SP+PP+ECD
MHPQVVILSLILHLADSVAGSVKVGGEAGPSVTLPCHYSGAVTSMCWNRGSCSLFTCQNGIVWTNGTHVTYRKDTRYKLLGDLSRRDVSLTIENTAVSDSGVYCCRVEHRGWFNDMKITVSLEIVPPKVTTTPIVTTVPTVTTVRTSTTVPTTTTVPMTTVPTTTVPTTMSIPTTTTVLTTMTVSTTTSVPTTTSIPTTTSVPVTTTVSTFVPPMPLPRQNHEPVATSPSSPQPAETHPTTLQGAIRREPTSSPLYSYTTDGNDTVTESSDGLWNNNQTQLFLEHSLLTANTTKG

SEQ ID NO: 2398 - protein, 202 aa, synthetic construct
  REGION 1..202: note = HAVCR2 (Q8TDQ0) SP+PP+ECD
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIG

SEQ ID NO: 2399 - protein, 160 aa, synthetic construct
  REGION 1..160: note = HBEGF (Q99075) SP+PP+ECD
MKLLPSVVLKLFLAAVLSALVTGESLERLRRGLAAGTSNPDPPTVSTDQLLPLGGGRDRKVRDLQEADLDLLRVTLSSKPQALATPNKEEHGKRKKKGKGLGKKRDPCLRKYKDFCIHGECKYVKELRAPSCICHPGYHGERCHGLSLPVENRLYTYDHT

SEQ ID NO: 2400 - protein, 1248 aa, synthetic construct
  REGION 1..1248: note = HEG1 (Q9ULI3) SP+PP+ECD
MASPRASRWPPPLLLLLLPLLLLPPAAPGTRDPPPSPARRALSLAPLAGAGLELQLERRPEREPPPTPPRERRGPATPGPSYRAPEPGAATQRGPSGRAPRGGSADAAWKHWPESNTEAHVENITFYQNQEDFSTVSSKEGVMVQTSGKSHAASDAPENLTLLAETADARGRSGSSSRTNFTILPVGYSLEIATALTSQSGNLASESLHLPSSSSEFDERIAAFQTKSGTASEMGTERAMGLSEEWTVHSQEATTSAWSPSFLPALEMGELTTPSRKRNSSGPDLSWLHFYRTAASSPLLDLSSSSESTEKLNNSTGLQSSSVSQTKTMHVATVFTDGGPRTLRSLTVSLGPVSKTEGFPKDSRIATTSSSVLLSPSAVESRRNSRVTGNPGDEEFIEPSTENEFGLTSLRWQNDSPTFGEHQLASSSEVQNGSPMSQTETVSRSVAPMRGGEITAHWLLTNSTTSADVTGSSASYPEGVNASVLTQFSDSTVQSGGSHTALGDRSYSESSSTSSSESLNSSAPRGERSIAGISYGQVRGTAIEQRTSSDHTDHTYLSSTFTKGERALLSITDNSSSSDIVESSTSYIKISNSSHSEYSSFFHAQTERSNISSYDGEYAQPSTESPVLHTSNLPSYTPTINMPNTSVVLDTDAEFVSDSSSSSSSSSSSSSSGPPLPLPSVSQSHHLFSSILPSTRASVHLLKSTSDASTPWSSSPSPLPVSLTTSTSAPLSVSQTTLPQSSSTPVLPRARETPVTSFQTSTMTSFMTMLHSSQTADLKSQSTPHQEKVITESKSPSLVSLPTESTKAVTTNSPLPPSLTESSTEQTLPATSTNLAQMSPTFTTTILKTSQPLMTTPGTLSSTASLVTGPIAVQTTAGKQLSLTHPEILVPQISTEGGISTERNRVIVDATTGLIPLTSVPTSAKEMTTKLGVTAEYSPASRSLGTSPSPQTTVVSTAEDLAPKSATFAVQSSTQSPTTVSSSASVNSCAVNPCLHNGECVADNTSRGYHCRCPPSWQGDDCSVDVNECLSNPCPSTAMCNNTQGSFICKCPVGYQLEKGICNLVRTFVTEFKLKRTFLNTTVEKHSDLQEVENEITKTLNMCFSALPSYIRSTVHASRESNAVVISLQTTFSLASNVTLFDLADRMQKCVNSCKSSAEVCQLLGSQRRIFRAGSLCKRKSPECDKDTSICTDLDGVALCQCKSGYFQFNKMDHSCRACEDGYRLENETCMSCPFGLGGLNCGNPYQL

SEQ ID NO: 2401 - protein, 240 aa, synthetic construct
  REGION 1..240: note = HEPACAM (Q14CZ8) SP+PP+ECD
MKRERGALSRASRALRLAPFVYLLLIQTDPLEGVNITSPVRLIHGTVGKSALLSVQYSSTSSDRPVVKWQLKRDKPVTVVQSIGTEVIGTLRPDYRDRIRLFENGSLLLSDLQLADEGTYEVEISITDDTFTGEKTINLTVDVPISRPQVLVASTTVLELSEAFTLNCSHENGTKPSYTWLKDGKPLLNDSRMLLSPDQKVLTITRVLMEDDDLYSCMVENPISQGRSLPVKITVYRRSS

SEQ ID NO: 2402 - protein, 351 aa, synthetic construct
  REGION 1..351: note = HEPACAM2 (A8MVW5) SP+PP+ECD
MGQDAFMEPFGDTLGVFQCKIYLLLFGACSGLKVTVPSHTVHGVRGQALYLPVHYGFHTPASDIQIIWLFERPHTMPKYLLGSVNKSVVPDLEYQHKFTMMPPNASLLINPLQFPDEGNYIVKVNIQGNGTLSASQKIQVTVDDPVTKPVVQIHPPSGAVEYVGNMTLTCHVEGGTRLAYQWLKNGRPVHTSSTYSFSPQNNTLHIAPVTKEDIGNYSCLVRNPVSEMESDIIMPIIYYGPYGLQVNSDKGLKVGEVFTVDLGEAILFDCSADSHPPNTYSWIRRTDNTTYIIKHGPRLEVASEKVAQKTMDYVCCAYNNITGRQDETHFTVIITSVGLEKLAQKGKSLSP

SEQ ID NO: 2403 - protein, 1110 aa, synthetic construct
  REGION 1..1110: note = HEPH (Q9BQS7) SP+PP+ECD
MESGHLLWALLFMQSLWPQLTDGATRVYYLGIRDVQWNYAPKGRNVITNQPLDSDIVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKRGALDGNSPPQRQDVDHDFFLLFSVVDENLSWHLNENIATYCSDPASVDKEDETFQESNRMHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDGSSYPGLVAKPFEKVTYRWTVPPHAGPTAQDPACLTWMYFSAADPIRDTNSGLVGPLLVCRAGALGADGKQKGVDKEFFLLFTVLDENKSWYSNANQAAAMLDFRLLSEDIEGFQDSNRMHAINGFLFSNLPRLDMCKGDTVAWHLLGLGTETDVHGVMFQGNTVQLQGMRKGAAMLFPHTFVMAIMQPDNLGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEPGEVVTYQWNIPERSGPGPNDSACVSWIYYSAVDPIKDMYSGLVGPLAICQKGILEPHGGRSDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKAVPPRDIEEGNVKMLGMQIPIKNVEMLAS

SEQ ID NO: 2404 - protein, 1114 aa, synthetic construct
  REGION 1..1114: note = HEPHL1 (Q6MZM0) SP+PP+ECD
MPRKQPAGCIFLLTFLGLSGLVGTVTRTYYIGIVEEYWNYVPQGKNVITGKSFTEDKLATLFLERGPNRIGSIYKKAVYRRFTDGTYSIEIPKPPWLGFLGPILRAEVGDVIVIHLKNFASRPYSLHPHGVFYNKDSEGALYPDGTSGRNKNDDMVPPGKNYTYVWPVREEYAPTPADANCLTWVYHSHIDAPKDICSGLIGPLLVCKEGILNRYSGTRNDVDREFVIMFTLVDENQSWYLNENIKHFCTNPDSVDKKDAVFQRSNKMHALNGYLFGNFPEPDMCVGESVSWHLFGMGNEIDIHSIYFYGNTFISRGHRTDVVNLFPATFLTTEMIAENPGKWMITCQVSDHLQAGMLGQYNVDNCKSDIFYPKMKGQQRRYFIAAEKILWDYAPQGYNKFSGLPLNASGSDSDLYFTQGDNRIGGKYWKVRYTEFVDATFTKRKRLSAEEAHLGILGPVIKAEVGDTLLVTFANKADKVYSILPHGVIYDKASDAAPNLDGFVKPGAHVKPGETFTYKWTVPESVSPTAGDPPCLTYLYFSAVDPIKDTSSGLVGPLLVCKKGVLNADGTQKGIDKEFYLLFTVFDENLSRYFDENIQKFIWHPFSIDKEDKEFVKSNRMHAVNGYMYGNQPGLNMCKRDRVSWHLIGLGTDTDMHGIVFQGNTIHLRGTHRDSLALFPHMATTAFMQPDHAGIFRVFCATMPHLSRGMGQIYEVSSCDNRDPSEQRYGMIRTFYIAAEEVEWDYAPNKNWEFEKQHVDARGERHGDIFMNRTENWIGSQYKKVVYREYTDGEFVEIKARPPREEHLELLGPMIHAEVGNTVLIIFKNKASRPYSISAQGVEEMDSGKQFQVPMTKPGEVKTYRWNIPKRSGPGPSDPNCIPWVYYSTVNFVKDTYSGLMGPLITCRKGVLNEKGRRSDVDYEFALLFLVFNENESWYLDDNIKKYLNKDPRDFKRTDDFEESNRMHAINGKIFGNLHGLIMNEDTMTNWYLLGIGSEVDIHTIHYHAESFLFKIDKSYREDVYDLFPGTFQTIELFADHPGTWLLHCHVSDHIHAGMETTYTVLRNIDNRIPYSTTSPGVASHPATVPSNERPGKEQLYFFGKNLGPTGAKA

SEQ ID NO: 2405 - protein, 515 aa, synthetic construct
  REGION 1..515: note = HERVH59 (Q9N2J8) SP+PP+ECD
MILAGRAPSNTSTLMKFYSLLLYSLLFSFPFLYHPLPLPSYLHHTINLTHSLPAASNPSLANNCWLCISLSSSAYIAVPTLQTDRATSPVSLHLRTSFNSPHLYPPEELIYFLDRSSKTSPDISHQPAAALLHIYLKNLSPYINSTPPIFGPLTTQTTIPVAAPLCISRQRPTGIPLGNISPSRCSFTLHLQSPTTHVTETIGVFQLHIIDKPSINTDKLKNVSSNYCLGRHLPYISLHPWLPSPCSSDSPPRPSSCLLTPSPQNNSERLLVDTQRFLIHHENRTSSSMQLAHQSPLQPLTAAALAGSLGVWVQDTPFSTPSHPFSLHLQFCLTQGLFFLCGSSTYMCLPANWTGTCTLVFLTPKIQFANGTKELPVPLMTLTPQKRVIPLIPLMVGLGLSASTIALSTGIAGISTSVTTFRSPSNDFSASITDISQTLSVLQAQVDSLAAVVLQNRRGLGLSILLNEECCFYLNQSGLVYENIKKLKDRAQKLANQASNYAESPWALSNWMSWV

SEQ ID NO: 2406 - protein, 523 aa, synthetic construct
  REGION 1..523: note = HERVH62 (Q9N2K0) SP+PP+ECD
MIFAGKAPSNTSTLMKFYSLLLYSLLFSFPFLCHPLPLPSYLHHTINLTHSLLAASNPSLVNNCWLCISLSSSAYTAVPAVQTDWATSPISLHLRTSFNSPHLYPPEELIYFLDRSSKTSPDISHQQAAALLRTYLKNLSPYINSTPPIFGPLTTQTTIPVAAPLCISWQRPTGIPLGNLSPSRCSFTLHLRSPTTNINETIGAFQLHITDKPSINTDKLKNISSNYCLGRHLPCISLHPWLSSPCSSDSPPRPSSCLLIPSPENNSERLLVDTRRFLIHHENRTFPSTQLPHQSPLQPLTAAALAGSLGVWVQDTPFSTPSHLFTLHLQFCLAQGLFFLCGSSTYMCLPANWTGTCTLVFLTPKIQFANGTEELPVPLMTPTQQKRVIPLIPLMVGLGLSASTVALGTGIAGISTSVMTFRSLSNDFSASITDISQTLSVLQAQVDSLAAVVLQNRRGLDLLTAEKGGLCIFLNEECCFYLNQSGLVYDNIKKLKDRAQKLANQASNYAEPPWALSNWMSWV

SEQ ID NO: 2407 - protein, 632 aa, synthetic construct
  REGION 1..632: note = HERVK_113 (Q902F9) SP+PP+ECD
MNPSEMQRKAPPRRRRHRNRAPLTHKMNKMVTSEEQMKLPSTKKAEPPTWAQLKKLTQLATKYLENTKVTQTPESMLLAALMIVSMVVSLPMPAGAAAANYTYWAYVPFPPLIRAVTWMDNPIEIYVNDSVWVPGPTDDCCPAKPEEEGMMINISIGYRYPPICLGRAPGCLMPAVQNWLVEVPTVSPISRFTYHMVSGMSLRPRVNYLQDFSYQRSLKFRPKGKPCPKEIPKESKNTEVLVWEECVANSAVILQNNEFGTLIDWAPRGQFYHNCSGQTQSCPSAQVSPAVDSDLTESLDKHKHKKLQSFYPWEWGEKGISTARPKIISPVSGPEHPELWRLTVASHHIRIWSGNQTLETRDRKPFYTIDLNSSLTVPLQSCVKPPYMLVVGNIVIKPDSQTITCENCRLLTCIDSTFNWQHRILLVRAREGVWIPVSMDRPWEASPSVHILTEVLKGVLNRSKRFIFTLIAVIMGLIAVTATAAVAGVALHSSVQSVNFVNDWQNNSTRLWNSQSSIDQKLANQINDLRQTVIWMGDRLMSLEHRFQLQCDWNTSDFCITPQIYNESEHHWDMVRCHLQGREDNLTLDISKLKEQIFEASKAHLNLVPGTEAIAGVADGLANLNTVTWVKT

SEQ ID NO: 2408 - protein, 306 aa, synthetic construct
  REGION 1..306: note = HFE (Q30201) SP+PP+ECD
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKESHTLQVILGCEMQEDNSTEGYWKYGYDGQDHLEFCPDTLDWRAAEPRAWPTKLEWERHKIRARQNRAYLERDCPAQLQQLLELGRGVLDQQVPPLVKVTHHVTSSVTTLRCRALNYYPQNITMKWLKDKQPMDAKEFEPKDVLPNGDGTYQGWITLAVPPGEEQRYTCQVEHPGLDQPLIVIWEPSPSGTLV

SEQ ID NO: 2409 - protein, 344 aa, synthetic construct
  REGION 1..344: note = HHLA2 (Q9UM44) SP+PP+ECD
MKAQTALSFFLILITSLSGSQGIFPLAFFIYVPMNEQIVIGRLDEDIILPSSFERGSEVVIHWKYQDSYKVHSYYKGSDHLESQDPRYANRTSLFYNEIQNGNASLFFRRVSLLDEGIYTCYVGTAIQVITNKVVLKVGVFLTPVMKYEKRNTNSFLICSVLSVYPRPIITWKMDNTPISENNMEETGSLDSFSINSPLNITGSNSSYECTIENSLLKQTWTGRWTMKDGLHKMQSEHVSLSCQPVNDYFSPNQDFKVTWSRMKSGTFSVLAYYLSSSQNTIINESRFSWNKELINQSDFSMNLMDLNLSDSGEYLCNISSDEYTLLTIHTVHVEPSQETASHN

SEQ ID NO: 2410 - protein, 117 aa, synthetic construct
  REGION 1..117: note = HIDE1 (A8MVS5) SP+PP+ECD
MPWTILLFAAGSLAIPAPSIRLVPPYPSSQEDPIHIACMAPGNFPGANFTLYRGGQVVQLLQAPTDQRGVTFNLSGGSSKAPGGPFHCQYGVLGELNQSQLSDLSEPVNVSFPVPTW

SEQ ID NO: 2411 - protein, 308 aa, synthetic construct
  REGION 1..308: note = HLA-A (P01891) SP+PP+ECD
MAVMAPRTLLLLLSGALALTQTWAGSHSMRYFFTSVSRPGRGEPRFIAVGYVDDTQFVRFDSDAASQRMEPRAPWIEQEGPEYWDQETRNVKAQSQTDRVDLGTLRGYYNQSEAGSHTIQIMYGCDVGSDGRFLRGYRQDAYDGKDYIALNEDLRSWTAADMAAQITKRKWEAAHEAEQLRAYLDGTCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPI

SEQ ID NO: 2412 - protein, 308 aa, synthetic construct; identical to SEQ ID NO: 2411
  REGION 1..308: note = HLA-A (P01892) SP+PP+ECD

SEQ ID NO: 2413 - protein, 308 aa, synthetic construct; identical to SEQ ID NO: 2411
  REGION 1..308: note = HLA-A (P04439) SP+PP+ECD

SEQ ID NO: 2414 - protein, 308 aa, synthetic construct; identical to SEQ ID NO: 2411
  REGION 1..308: note = HLA-A (P05534) SP+PP+ECD

SEQ ID NO: 2415 - protein, 308 aa, synthetic construct; identical to SEQ ID NO: 2411
  REGION 1..308: note = HLA-A (P10314) SP+PP+ECD

SEQ ID NO: 2416 - protein, 308 aa, synthetic construct; identical to SEQ ID NO: 2411
  REGION 1..308: note = HLA-A (P10316) SP+PP+ECD

SEQ ID NO: 2417 - protein, 308 aa, synthetic construct; identical to SEQ ID NO: 2411
  REGION 1..308: note = HLA-A (P13746) SP+PP+ECD

SEQ ID NO: 2418 - protein, 308 aa, synthetic construct; identical to SEQ ID NO: 2411
  REGION 1..308: note = HLA-A (P16188) SP+PP+ECD

SEQ ID NO: 2419 - protein, 308 aa, synthetic construct; identical to SEQ ID NO: 2411
  REGION 1..308: note = HLA-A (P16189) SP+PP+ECD

SEQ ID NO: 2420 - protein, 308 aa, synthetic construct; identical to SEQ ID NO: 2411
  REGION 1..308: note = HLA-A (P16190) SP+PP+ECD

SEQ ID NO: 2421 - protein, 308 aa, synthetic construct; identical to SEQ ID NO: 2411
  REGION 1..308: note = HLA-A (P18462) SP+PP+ECD

SEQ ID NO: 2422 - protein, 308 aa, synthetic construct; identical to SEQ ID NO: 2411
  REGION 1..308: note = HLA-A (P30443) SP+PP+ECD

SEQ ID NO: 2423 - protein, 308 aa, synthetic construct; identical to SEQ ID NO: 2411
  REGION 1..308: note = HLA-A (P30447) SP+PP+ECD

SEQ ID NO: 2424 - protein, 308 aa, synthetic construct; identical to SEQ ID NO: 2411
  REGION 1..308: note = HLA-A (P30450) SP+PP+ECD

SEQ ID NO: 2425 - protein, 308 aa, synthetic construct; identical to SEQ ID NO: 2411
  REGION 1..308: note = HLA-A (P30453) SP+PP+ECD

SEQ ID NO: 2426 - protein, 308 aa, synthetic construct; identical to SEQ ID NO: 2411
  REGION 1..308: note = HLA-A (P30455) SP+PP+ECD

SEQ ID NO: 2427 - protein, 308 aa, synthetic construct; identical to SEQ ID NO: 2411
  REGION 1..308: note = HLA-A (P30456) SP+PP+ECD

SEQ ID NO: 2428 - protein, 308 aa, synthetic construct; identical to SEQ ID NO: 2411
  REGION 1..308: note = HLA-A (P30457) SP+PP+ECD

SEQ ID NO: 2429 - protein, 308 aa, synthetic construct; identical to SEQ ID NO: 2411
  REGION 1..308: note = HLA-A (P30459) SP+PP+ECD

SEQ ID NO: 2430 - protein, 308 aa, synthetic construct; identical to SEQ ID NO: 2411
  REGION 1..308: note = HLA-A (P30512) SP+PP+ECD

SEQ ID NO: 2431 - protein, 308 aa, synthetic construct; identical to SEQ ID NO: 2411
  REGION 1..308: note = HLA-A (Q09160) SP+PP+ECD

SEQ ID NO: 2432 - protein, 309 aa, synthetic construct
  REGION 1..309: note = HLA-B (P01889) SP+PP+ECD
MLVMAPRTVLLLLSAALALTETWAGSHSMRYFYTSVSRPGRGEPRFISVGYVDDTQFVRFDSDAASPREEPRAPWIEQEGPEYWDRNTQIYKAQAQTDRESLRNLRGYYNQSEAGSHTLQSMYGCDVGPDGRLLRGHDQYAYDGKDYIALNEDLRSWTAADTAAQITQRKWEAAREAEQRRAYLEGECVEWLRRYLENGKDKLERADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTVPIV

SEQ ID NO: 2433 - protein, 309 aa, synthetic construct; identical to SEQ ID NO: 2432
  REGION 1..309: note = HLA-B (P03989) SP+PP+ECD

SEQ ID NO: 2434 - protein, 309 aa, synthetic construct; identical to SEQ ID NO: 2432
  REGION 1..309: note = HLA-B (P10319) SP+PP+ECD

SEQ ID NO: 2435 - protein, 309 aa, synthetic construct; identical to SEQ ID NO: 2432
  REGION 1..309: note = HLA-B (P18463) SP+PP+ECD

SEQ ID NO: 2436 - protein, 309 aa, synthetic construct; identical to SEQ ID NO: 2432
  REGION 1..309: note = HLA-B (P18464) SP+PP+ECD

SEQ ID NO: 2437 - protein, 309 aa, synthetic construct; identical to SEQ ID NO: 2432
  REGION 1..309: note = HLA-B (P18465) SP+PP+ECD

SEQ ID NO: 2438 - protein, 309 aa, synthetic construct; identical to SEQ ID NO: 2432
  REGION 1..309: note = HLA-B (P30460) SP+PP+ECD

SEQ ID NO: 2439 - protein, 309 aa, synthetic construct; identical to SEQ ID NO: 2432
  REGION 1..309: note = HLA-B (P30461) SP+PP+ECD

SEQ ID NO: 2440 - protein, 309 aa, synthetic construct; identical to SEQ ID NO: 2432
  REGION 1..309: note = HLA-B (P30462) SP+PP+ECD

SEQ ID NO: 2441 - protein, 309 aa, synthetic construct; identical to SEQ ID NO: 2432
  REGION 1..309: note = HLA-B (P30464) SP+PP+ECD

SEQ ID NO: 2442 - protein, 309 aa, synthetic construct; identical to SEQ ID NO: 2432
  REGION 1..309: note = HLA-B (P30466) SP+PP+ECD

SEQ ID NO: 2443 - protein, 309 aa, synthetic construct; identical to SEQ ID NO: 2432
  REGION 1..309: note = HLA-B (P30475) SP+PP+ECD

SEQ ID NO: 2444 - protein, 309 aa, synthetic construct; identical to SEQ ID NO: 2432
  REGION 1..309: note = HLA-B (P30479) SP+PP+ECD

SEQ ID NO: 2445 - protein, 309 aa, synthetic construct; identical to SEQ ID NO: 2432
  REGION 1..309: note = HLA-B (P30480) SP+PP+ECD

SEQ ID NO: 2446 - protein, 309 aa, synthetic construct; identical to SEQ ID NO: 2432
  REGION 1..309: note = HLA-B (P30481) SP+PP+ECD

SEQ ID NO: 2447 - protein, 309 aa, synthetic construct; identical to SEQ ID NO: 2432
  REGION 1..309: note = HLA-B (P30483) SP+PP+ECD

SEQ ID NO: 2448 - protein, 309 aa, synthetic construct; identical to SEQ ID NO: 2432
  REGION 1..309: note = HLA-B (P30484) SP+PP+ECD

SEQ ID NO: 2449 - protein, 309 aa, synthetic construct; identical to SEQ ID NO: 2432
  REGION 1..309: note = HLA-B (P30485) SP+PP+ECD

SEQ ID NO: 2450 - protein, 309 aa, synthetic construct; identical to SEQ ID NO: 2432
  REGION 1..309: note = HLA-B (P30486) SP+PP+ECD

SEQ ID NO: 2451 - protein, 309 aa, synthetic construct; identical to SEQ ID NO: 2432
  REGION 1..309: note = HLA-B (P30487) SP+PP+ECD

SEQ ID NO: 2452 - protein, 309 aa, synthetic construct; identical to SEQ ID NO: 2432
  REGION 1..309: note = HLA-B (P30488) SP+PP+ECD

SEQ ID NO: 2453 - protein, 309 aa, synthetic construct; identical to SEQ ID NO: 2432
  REGION 1..309: note = HLA-B (P30490) SP+PP+ECD

SEQ ID NO: 2454 - protein, 309 aa, synthetic construct; identical to SEQ ID NO: 2432
  REGION 1..309: note = HLA-B (P30491) SP+PP+ECD

SEQ ID NO: 2455 - protein, 309 aa, synthetic construct; identical to SEQ ID NO: 2432
  REGION 1..309: note = HLA-B (P30492) SP+PP+ECD

SEQ ID NO: 2456 - protein, 309 aa, synthetic construct; identical to SEQ ID NO: 2432
  REGION 1..309: note = HLA-B (P30493) SP+PP+ECD

SEQ ID NO: 2457 - protein, 309 aa, synthetic construct; identical to SEQ ID NO: 2432
  REGION 1..309: note = HLA-B (P30495) SP+PP+ECD

SEQ ID NO: 2458 - protein, 309 aa, synthetic construct; identical to SEQ ID NO: 2432
  REGION 1..309: note = HLA-B (P30498) SP+PP+ECD

SEQ ID NO: 2459 - protein, 309 aa, synthetic construct; identical to SEQ ID NO: 2432
  REGION 1..309: note = HLA-B (P30685) SP+PP+ECD

SEQ ID NO: 2460 - protein, 309 aa, synthetic construct; identical to SEQ ID NO: 2432
  REGION 1..309: note = HLA-B (Q04826) SP+PP+ECD

SEQ ID NO: 2461 - protein, 309 aa, synthetic construct; identical to SEQ ID NO: 2432
  REGION 1..309: note = HLA-B (Q29718) SP+PP+ECD

SEQ ID NO: 2462 - protein, 309 aa, synthetic construct; identical to SEQ ID NO: 2432
  REGION 1..309: note = HLA-B (Q29836) SP+PP+ECD

SEQ ID NO: 2463 - protein, 309 aa, synthetic construct; identical to SEQ ID NO: 2432
  REGION 1..309: note = HLA-B (Q29940) SP+PP+ECD

SEQ ID NO: 2464 - protein, 309 aa, synthetic construct; identical to SEQ ID NO: 2432
  REGION 1..309: note = HLA-B (Q31610) SP+PP+ECD

SEQ ID NO: 2465 - protein, 309 aa, synthetic construct; identical to SEQ ID NO: 2432
  REGION 1..309: note = HLA-B (Q31612) SP+PP+ECD

SEQ ID NO: 2466 - protein, 309 aa, synthetic construct; identical to SEQ ID NO: 2432
  REGION 1..309: note = HLA-B (Q95365) SP+PP+ECD

SEQ ID NO: 2467 - protein, 308 aa, synthetic construct
  REGION 1..308: note = HLA-C (P04222) SP+PP+ECD
MRVMAPRALLLLLSGGLALTETWACSHSMRYFDTAVSRPGRGEPRFISVGYVDDTQFVRFDSDAASPRGEPRAPWVEQEGPEYWDRETQKYKRQAQADRVSLRNLRGYYNQSEDGSHTLQRMSGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEPSSQPTIPI

SEQ ID NO: 2468 - protein, 308 aa, synthetic construct; identical to SEQ ID NO: 2467
  REGION 1..308: note = HLA-C (P10321) SP+PP+ECD

SEQ ID NO: 2469 - protein, 308 aa, synthetic construct; identical to SEQ ID NO: 2467
  REGION 1..308: note = HLA-C (P30499) SP+PP+ECD

SEQ ID NO: 2470 - protein, 308 aa, synthetic construct; identical to SEQ ID NO: 2467
  REGION 1..308: note = HLA-C (P30501) SP+PP+ECD

SEQ ID NO: 2471 - protein, 308 aa, synthetic construct; identical to SEQ ID NO: 2467
  REGION 1..308: note = HLA-C (P30504) SP+PP+ECD

SEQ ID NO: 2472 - protein, 308 aa, synthetic construct; identical to SEQ ID NO: 2467
  REGION 1..308: note = HLA-C (P30505) SP+PP+ECD

SEQ ID NO: 2473 - protein, 308 aa, synthetic construct; identical to SEQ ID NO: 2467
  REGION 1..308: note = HLA-C (P30508) SP+PP+ECD

SEQ ID NO: 2474 - protein, 308 aa, synthetic construct; identical to SEQ ID NO: 2467
  REGION 1..308: note = HLA-C (P30510) SP+PP+ECD

SEQ ID NO: 2475 - protein, 308 aa, synthetic construct; identical to SEQ ID NO: 2467
  REGION 1..308: note = HLA-C (Q07000) SP+PP+ECD

SEQ ID NO: 2476 - protein, 308 aa, synthetic construct; identical to SEQ ID NO: 2467
  REGION 1..308: note = HLA-C (Q29865) SP+PP+ECD

SEQ ID NO: 2477 - protein, 308 aa, synthetic construct; identical to SEQ ID NO: 2467
  REGION 1..308: note = HLA-C (Q29960) SP+PP+ECD

SEQ ID NO: 2478 - protein, 308 aa, synthetic construct; identical to SEQ ID NO: 2467
  REGION 1..308: note = HLA-C (Q29963) SP+PP+ECD

SEQ ID NO: 2479 - protein, 308 aa, synthetic construct; identical to SEQ ID NO: 2467
  REGION 1..308: note = HLA-C (Q95604) SP+PP+ECD

SEQ ID NO: 2480 - protein, 308 aa, synthetic construct; identical to SEQ ID NO: 2467
  REGION 1..308: note = HLA-C (Q9TNN7) SP+PP+ECD

SEQ ID NO: 2481 - protein, 233 aa, synthetic construct
  REGION 1..233: note = HLA-DMA (P28067) SP+PP+ECD
MGHEQNQGAALLQMLPLLWLLPHSWAVPEAPTPMWPDDLQNHTFLHTVYCQDGSPSVGLSEAYDEDQLFFFDFSQNTRVPRLPEFADWAQEQGDAPAILFDKEFCEWMIQQIGPKLDGKIPVSRGFPIAEVFTLKPLEFGKPNTLVCFVSNLFPPMLTVNWHDHSVPVEGFGPTFVSAVDGLSFQAFSYLNFTPEPSDIFSCIVTHEIDRYTAIAYWVPRNALPSDLLENVLC

SEQ ID NO: 2482 - protein, 218 aa, synthetic construct
  REGION 1..218: note = HLA-DMB (P28068) SP+PP+ECD
MITFLPLLLGLSLGCTGAGGFVAHVESTCLLDDAGTPKDFTYCISFNKDLLTCWDPEENKMAPCEFGVLNSLANVLSQHLNQKDTLMQRLRNGLQNCATHTQPFWGSLTNRTRPPSVQVAKTTPFNTREPVMLACYVWGFYPAEVTITWRKNGKLVMPHSSAHKTAQPNGDWTYQTLSHLALTPSYGDTYTCVVEHIGAPEPILRDWTPGLSPMQTLK

SEQ ID NO: 2483 - protein, 217 aa, synthetic construct
  REGION 1..217: note = HLA-DOA (P06340) SP+PP+ECD
MALRAGLVLGFHTLMTLLSPQEAGATKADHMGSYGPAFYQSYGASGQFTHEFDEEQLFSVDLKKSEAVWRLPEFGDFARFDPQGGLAGIAAIKAHLDILVERSNRSRAINVPPRVTVLPKSRVELGQPNILICIVDNIFPPVINITWLRNGQTVTEGVAQTSFYSQPDHLFRKFHYLPFVPSAEDVYDCQVEHWGLDAPLLRHWELQVPIPPPDAME

SEQ ID NO: 2484 - protein, 224 aa, synthetic construct
  REGION 1..224: note = HLA-DOB (P13765) SP+PP+ECD
MGSGWVPWVVALLVNLTRLDSSMTQGTDSPEDFVIQAKADCYFTNGTEKVQFVVRFIFNLEEYVRFDSDVGMFVALTKLGQPDAEQWNSRLDLLERSRQAVDGVCRHNYRLGAPFTVGRKVQPEVTVYPERTPLLHQHNLLHCSVTGFYPGDIKIKWFLNGQEERAGVMSTGPIRNGDWTFQTVVMLEMTPELGHVYTCLVDHSSLLSPVSVEWRAQSEYSWRK

SEQ ID NO: 2485 - protein, 222 aa, synthetic construct
  REGION 1..222: note = HLA-DPA1 (P20036) SP+PP+ECD
MRPEDRMFHIRAVILRALSLAFLLSLRGAGAIKADHVSTYAAFVQTHRPTGEFMFEFDEDEMFYVDLDKKETVWHLEEFGQAFSFEAQGGLANIAILNNNLNTLIQRSNHTQATNDPPEVTVFPKEPVELGQPNTLICHIDKFFPPVLNVTWLCNGELVTEGVAESLFLPRTDYSFHKFHYLTFVPSAEDFYDCRVEHWGLDQPLLKHWEAQEPIQMPETTE

SEQ ID NO: 2486 - protein, 225 aa, synthetic construct
  REGION 1..225: note = HLA-DPB1 (P04440) SP+PP+ECD
MMVLQVSAAPRTVALTALLMVLLTSVVQGRATPENYLFQGRQECYAFNGTQRFLERYIYNREEFARFDSDVGEFRAVTELGRPAAEYWNSQKDILEEKRAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSK

SEQ ID NO: 2487 - protein, 216 aa, synthetic construct
  REGION 1..216: note = HLA-DQA1 (P01909) SP+PP+ECD
MILNKALMLGALALTTVMSPCGGEDIVADHVASYGVNLYQSYGPSGQYTHEFDGDEQFYVDLGRKETVWCLPVLRQFRFDPQFALTNIAVLKHNLNSLIKRSNSTAATNEVPEVTVFSKSPVTLGQPNILICLVDNIFPPVVNITWLSNGHSVTEGVSETSFLSKSDHSFFKISYLTLLPSAEESYDCKVEHWGLDKPLLKHWEPEIPAPMSELTE

SEQ ID NO: 2488 - protein, 217 aa, synthetic construct
  REGION 1..217: note = HLA-DQA2 (P01906) SP+PP+ECD
MILNKALLLGALALTAVMSPCGGEDIVADHVASYGVNFYQSHGPSGQYTHEFDGDEEFYVDLETKETVWQLPMFSKFISFDPQSALRNMAVGKHTLEFMMRQSNSTAATNEVPEVTVFSKFPVTLGQPNTLICLVDNIFPPVVNITWLSNGHSVTEGVSETSFLSKSDHSFFKISYLTFLPSADEIYDCKVEHWGLDEPLLKHWEPEIPAPMSELTE

SEQ ID NO: 2489 - protein, 230 aa, synthetic construct
  REGION 1..230: note = HLA-DQB1 (P01920) SP+PP+ECD
MSWKKALRIPGGLRAATVTLMLAMLSTPVAEGRDSPEDFVYQFKAMCYFTNGTERVRYVTRYIYNREEYARFDSDVEVYRAVTPLGPPDAEYWNSQKEVLERTRAELDTVCRHNYQLELRTTLQRRVEPTVTISPSRTEALNHHNLLVCSVTDFYPAQIKVRWFRNDQEETTGVVSTPLIRNGDWTFQILVMLEMTPQHGDVYTCHVEHPSLQNPITVEWRAQSESAQSK

SEQ ID NO: 2490 - protein, 229 aa, synthetic construct
  REGION 1..229: note = HLA-DQB2 (P05538) SP+PP+ECD
MSWKMALQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRTTLQRQVEPTVTISPSRTEALNHHNLLVCSVTDFYPAQIKVRWFRNDQEETAGVVSTSLIRNGDWTFQILVMLEITPQRGDIYTCQVEHPSLQSPITVEWRAQSESAQSK

SEQ ID NO: 2491 - protein, 216 aa, synthetic construct
  REGION 1..216: note = HLA-DRA (P01903) SP+PP+ECD
MAISGVPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSNYTPITNVPPEVTVLTNSPVELREPNVLICFIDKFTPPVVNVTWLRNGKPVTTGVSETVFLPREDHLFRKFHYLPFLPSTEDVYDCRVEHWGLDEPLLKHWEFDAPSPLPETTE

SEQ ID NO: 2492 - protein, 227 aa, synthetic construct
  REGION 1..227: note = HLA-DRB1 (P01911) SP+PP+ECD
MVCLKLPGGSCMTALTVTLMVLSSPLALSGDTRPRFLWQPKRECHFFNGTERVRFLDRYFYNQEESVRFDSDVGEFRAVTELGRPDAEYWNSQKDILEQARAAVDTYCRHNYGVVESFTVQRRVQPKVTVYPSKTQPLQHHNLLVCSVSGFYPGSIEVRWFLNGQEEKAGMVSTGLIQNGDWTFQTLVMLETVPRSGEVYTCQVEHPSVTSPLTVEWRARSESAQSK

SEQ ID NO: 2493 - protein, 227 aa, synthetic construct
  REGION 1..227: note = HLA-DRB3 (P79483) SP+PP+ECD
MVCLKLPGGSSLAALTVTLMVLSSRLAFAGDTRPRFLELRKSECHFFNGTERVRYLDRYFHNQEEFLRFDSDVGEYRAVTELGRPVAESWNSQKDLLEQKRGRVDNYCRHNYGVGESFTVQRRVHPQVTVYPAKTQPLQHHNLLVCSVSGFYPGSIEVRWFRNGQEEKAGVVSTGLIQNGDWTFQTLVMLETVPRSGEVYTCQVEHPSVTSALTVEWRARSESAQSK

SEQ ID NO: 2494 - protein, 227 aa, synthetic construct
  REGION 1..227: note = HLA-DRB4 (P13762) SP+PP+ECD
MVCLKLPGGSCMAALTVTLTVLSSPLALAGDTQPRFLEQAKCECHFLNGTERVWNLIRYIYNQEEYARYNSDLGEYQAVTELGRPDAEYWNSQKDLLERRRAEVDTYCRYNYGVVESFTVQRRVQPKVTVYPSKTQPLQHHNLLVCSVNGFYPGSIEVRWFRNGQEEKAGVVSTGLIQNGDWTFQTLVMLETVPRSGEVYTCQVEHPSMMSPLTVQWSARSESAQSK

SEQ ID NO: 2495 - protein, 227 aa, synthetic construct
  REGION 1..227: note = HLA-DRB5 (Q30154) SP+PP+ECD
MVCLKLPGGSYMAKLTVTLMVLSSPLALAGDTRPRFLQQDKYECHFFNGTERVRFLHRDIYNQEEDLRFDSDVGEYRAVTELGRPDAEYWNSQKDFLEDRRAAVDTYCRHNYGVGESFTVQRRVEPKVTVYPARTQTLQHHNLLVCSVNGFYPGSIEVRWFRNSQEEKAGVVSTGLIQNGDWTFQTLVMLETVPRSGEVYTCQVEHPSVTSPLTVEWRAQSESAQSK

SEQ ID NO: 2496 - protein, 305 aa, synthetic construct
  REGION 1..305: note = HLA-E (P13747) SP+PP+ECD
MVDGTLLLLLSEALALTQTWAGSHSLKYFHTSVSRPGRGEPRFISVGYVDDTQFVRFDNDAASPRMVPRAPWMEQEGSEYWDRETRSARDTAQIFRVNLRTLRGYYNQSEAGSHTLQWMHGCELGPDGRFLRGYEQFAYDGKDYLTLNEDLRSWTAVDTAAQISEQKSNDASEAEHQRAYLEDTCVEWLHKYLEKGKETLLHLEPPKTHVTHHPISDHEATLRCWALGFYPAEITLTWQQDGEGHTQDTELVETRPAGDGTFQKWAAVVVPSGEEQRYTCHVQHEGLPEPVTLRWKPASQPTIPI

SEQ ID NO: 2497 - protein, 305 aa, synthetic construct
  REGION 1..305: note = HLA-F (P30511) SP+PP+ECD
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPPGEEQRYTCHVQHEGLPQPLILRWEQSPQPTIPI

SEQ ID NO: 2498 - protein, 308 aa, synthetic construct
  REGION 1..308: note = HLA-G (P17693) SP+PP+ECD
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPI

SEQ ID NO: 2499 - protein, 308 aa, synthetic construct
  REGION 1..308: note = HLA-H (P01893) SP+PP+ECD
MVLMAPRTLLLLLSGALALTQTWARSHSMRYFYTTMSRPGAGEPRFISVGYVDDTQFVRFDSDDASPREEPRAPWMEREGPKYWDRNTQICKAQAQTERENLRIALRYYNQSEGGSHTMQVMYGCDVGPDGPFLRGYEQHAYDGKDYIALNEDLRSWTAADMAAQITKRKWEAARRAEQRRVYLEGEFVEWLRRYLENGKETLQRADPPKTHMTHHPISDHEATLRCWALGFYPAEITLTWQRDGEDQTQDTELVETRPAGDGTFQKWAAVVVPSGEEQRYTCHVQHEGLPEPLTLRWEPSSQPTVPI

SEQ ID NO: 2500 - protein, 480 aa, synthetic construct
  REGION 1..480: note = ICAM1 (P05362) SP+PP+ECD
MAPSSPRPALPALLVLLGALFPGPGNAQTSVSPSKVILPRGGSVLVTCSTSCDQPKLLGIETPLPKKELLLPGNNRKVYELSNVQEDSQPMCYSNCPDGQSTAKTFLTVYWTPERVELAPLPSWQPVGKNLTLRCQVEGGAPRANLTVVLLRGEKELKREPAVGEPAEVTTTVLVRRDHHGANFSCRTELDLRPQGLELFENTSAPYQLQTFVLPATPPQLVSPRVLEVDTQGTVVCSLDGLFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAQPLGPRAQLLLKATPEDNGRSFSCSATLEVAGQLIHKNQTRELRVLYGPRLDERDCPGNWTWPENSQQTPMCQAWGNPLPELKCLKDGTFPLPIGESVTVTRDLEGTYLCRARSTQGEVTRKVTVNVLSPRYE

SEQ ID NO: 2501 - protein, 223 aa, synthetic construct
  REGION 1..223: note = ICAM2 (P13598) SP+PP+ECD
MSSFGYRTLTVALFTLICCPGSDEKVFEVHVRPKKLAVEPKGSLEVNCSTTCNQPEVGGLETSLDKILLDEQAQWKHYLVSNISHDTVLQCHFTCSGKQESMNSNVSVYQPPRQVILTLQPTLVAVGKSFTIECRVPTVEPLDSLTLFLFRGNETLHYETFGKAAPAPQEATATFNSTADREDGHRNFSCLAVLDLMSRGGNIFHKHSAPKMLEIYEPVSDSQ

SEQ ID NO: 2502 - protein, 485 aa, synthetic construct
  REGION 1..485: note = ICAM3 (P32942) SP+PP+ECD
MATMVPSVLWPRACWTLLVCCLLTPGVQGQEFLLRVEPQNPVLSAGGSLFVNCSTDCPSSEKIALETSLSKELVASGMGWAAFNLSNVTGNSRILCSVYCNGSQITGSSNITVYRLPERVELAPLPPWQPVGQNFTLRCQVEDGSPRTSLTVVLLRWEEELSRQPAVEEPAEVTATVLASRDDHGAPFSCRTELDMQPQGLGLFVNTSAPRQLRTFVLPVTPPRLVAPRFLEVETSWPVDCTLDGLFPASEAQVYLALGDQMLNATVMNHGDTLTATATATARADQEGAREIVCNVTLGGERREARENLTVFSFLGPIVNLSEPTAHEGSTVTVSCMAGARVQVTLDGVPAAAPGQPAQLQLNATESDDGRSFFCSATLEVDGEFLHRNSSVQLRVLYGPKIDRATCPQHLKWKDKTRHVLQCQARGNPYPELRCLKEGSSREVPVGIPFFVNVTHNGTYQCQASSSRGKYTLVVVMDIEAGSSH

SEQ ID NO: 2503 - protein, 240 aa, synthetic construct
  REGION 1..240: note = ICAM4 (Q14773) SP+PP+ECD
MGSLFPLSLLFFLAAAYPGVGSALGRRTKRAQSPKGSPLAPSGTSVPFWVRMSPEFVAVQPGKSVQLNCSNSCPQPQNSSLRTPLRQGKTLRGPGWVSYQLLDVRAWSSLAHCLVTCAGKTRWATSRITAYKPPHSVILEPPVLKGRKYTLRCHVTQVFPVGYLVVTLRHGSRVIYSESLERFTGLDLANVTLTYEFAAGPRDFWQPVICHARLNLDGLVVRNSSAPITLMLAWSPAPTA

SEQ ID NO: 2504 - protein, 835 aa, synthetic construct
  REGION 1..835: note = ICAM5 (Q9UMF0) SP+PP+ECD
MPGPSPGLRRALLGLWAALGLGLFGLSAVSQEPFWADLQPRVAFVERGGSLWLNCSTNCPRPERGGLETSLRRNGTQRGLRWLARQLVDIREPETQPVCFFRCARRTLQARGLIRTFQRPDRVELMPLPPWQPVGENFTLSCRVPGAGPRASLTLTLLRGAQELIRRSFAGEPPRARGAVLTATVLARREDHGANFSCRAELDLRPHGLGLFENSSAPRELRTFSLSPDAPRLAAPRLLEVGSERPVSCTLDGLFPASEARVYLALGDQNLSPDVTLEGDAFVATATATASAEQEGARQLVCNVTLGGENRETRENVTIYSFPAPLLTLSEPSVSEGQMVTVTCAAGAQALVTLEGVPAAVPGQPAQLQLNATENDDRRSFFCDATLDVDGETLIKNRSAELRVLYAPRLDDSDCPRSWTWPEGPEQTLRCEARGNPEPSVHCARSDGGAVLALGLLGPVTRALSGTYRCKAANDQGEAVKDVTLTVEYAPALDSVGCPERITWLEGTEASLSCVAHGVPPPDVICVRSGELGAVIEGLLRVAREHAGTYRCEATNPRGSAAKNVAVTVEYGPRFEEPSCPSNWTWVEGSGRLFSCEVDGKPQPSVKCVGSGGATEGVLLPLAPPDPSPRAPRIPRVLAPGIYVCNATNRHGSVAKTVVVSAESPPEMDESTCPSHQTWLEGAEASALACAARGRPSPGVRCSREGIPWPEQQRVSREDAGTYHCVATNAHGTDSRTVTVGVEYRPVVAELAASPPGGVRPGGNFTLTCRAEAWPPAQISWRAPPGALNIGLSSNNSTLSVAGAMGSHGGEYECAATNAHGRHARRITVRVAGPW

SEQ ID NO: 2505 - protein, 140 aa, synthetic construct
  REGION 1..140: note = ICOS (Q9Y6W8) SP+PP+ECD
MKSGLWYFFLFCLRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLK

SEQ ID NO: 2506 - protein, 256 aa, synthetic construct
  REGION 1..256: note = ICOSLG (O75144) SP+PP+ECD
MRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2507 - protein, 436 aa, synthetic construct
  REGION 1..436: note = IFNAR1 (P17181) SP+PP+ECD
MMVVLLGATTLVLVAVAPWVLSAAAGGKNLKSPQKVEVDIIDDNFILRWNRSDESVGNVTFSFDYQKTGMDNWIKLSGCQNITSTKCNFSSLKLNVYEEIKLRIRAEKENTSSWYEVDSFTPFRKAQIGPPEVHLEAEDKAIVIHISPGTKDSVMWALDGLSFTYSLVIWKNSSGVEERIENIYSRHKIYKLSPETTYCLKVKAALLTSWKIGVYSPVHCIKTTVENELPPPENIEVSVQNQNYVLKWDYTYANMTFQVQWLHAFLKRNPGNHLYKWKQIPDCENVKTTQCVFPQNVFQKGIYLLRVQASDGNNTSFWSEEIKFDTEIQAFLLPPVFNIRSLSDSFHIYIGAPKQSGNTPVIQDYPLIYEIIFWENTSNAERKIIEKKTDVTVPNLKPLTVYCVKARAHTMDEKLNKSSVFSDAVCEKTKPGNTSK

SEQ ID NO: 2508 - protein, 243 aa, synthetic construct
  REGION 1..243: note = IFNAR2 (P48551) SP+PP+ECD
MLLSQNAFIFRSLNLVLMVYISLVFGISYDSPDYTDESCTFKISLRNFRSILSWELKNHSIVPTHYTLLYTIMSKPEDLKVVKNCANTTRSFCDLTDEWRSTHEAYVTVLEGFSGNTTLFSCSHNFWLAIDMSFEPPEFEIVGFTNHINVMVKFPSIVEEELQFDLSLVIEEQSEGIVKKHKPEIKGNMSGNFTYIIDKLIPNTNYCVSVYLEHSDEQAVIKSPLKCTLLPPGQESESAESAK

SEQ ID NO: 2509 - protein, 245 aa, synthetic construct
  REGION 1..245: note = IFNGR1 (P15260) SP+PP+ECD
MALLFLLPLVMQGVSRAEMGTADLGPSSVPTPTNVTIESYNMNPIVYWEYQIMPQVPVFTVEVKNYGVKNSEWIDACINISHHYCNISDHVGDPSNSLWVRVKARVGQKESAYAKSEEFAVCRDGKIGPPKLDIRKEEKQIMIDIFHPSVFVNGDEQEVDYDPETTCYIRVYNVYVRMNGSEIQYKILTQKEDDCDEIQCQLAIPVSSLNSQYCVSAEGVLHVWGVTTEKSKEVCITIFNSSIKG

SEQ ID NO: 2510 - protein, 241 aa, synthetic construct
  REGION 1..241: note = IFNGR2 (P38484) SP+PP+ECD
MRPTLLWSLLLLLGVFAAAAASQLPAPQHPKIRLYNAEQVLSWEPVALSNSTRPVVYQVQFKYTDSKWFTADIMSIGVNCTQITATECDFTAASPSAGFPMDFNVTLRLRAELGALHSAWVTMPWFQHYRNVTVGPPENIEVTPGEGSLIIRFSSPFDIADTSTAFFCYYVHYWEKGGIQQVKGPFRSNSISLDNLKPSRVYCLQVQAQLLWNKSNIFRVGHLSNISCYETMADASTELQQ

SEQ ID NO: 2511 - protein, 228 aa, synthetic construct
  REGION 1..228: note = IFNLR1 (Q8IU57) SP+PP+ECD
MAGPERWGPLLLCLLQAAPGRPRLAPPQNVTLLSQNFSVYLTWLPGLGNPQDVTYFVAYQSSPTRRRWREVEECAGTKELLCSMMCLKKQDLYNKFKGRVRTVSPSSKSPWVESEYLDYLFEVEPAPPVLVLTQTEEILSANATYQLPPCMPPLDLKYEVAFWKEGAGNKTLFPVTPHGQPVQITLQPAASEHHCLSARTIYTFSVPKYSKFSKPTCFLLEVPEANWA

SEQ ID NO: 2512 - protein, 640 aa, synthetic construct
  REGION 1..640: note = IGDCC3 (Q8IVU1) SP+PP+ECD
MAVQRAASPRRPPAPLWPRLLLPLLLLLLPAPSEGLGHSAELAFAVEPSDDVAVPGQPIVLDCRVEGTPPVRITWRKNGVELPESTHSTLLANGSLMIRHFRLEPGGSPSDEGDYECVAQNRFGLVVSRKARIQAATMSDFHVHPQATVGEEGGVARFQCQIHGLPKPLITWEKNRVPIDTDNERYTLLPKGVLQITGLRAEDGGIFHCVASNIASIRISHGARLTVSGSGSGAYKEPAILVGPENLTLTVHQTAVLECVATGNPRPIVSWSRLDGRPIGVEGIQVLGTGNLIISDVTVQHSGVYVCAANRPGTRVRRTAQGRLVVQAPAEFVQHPQSISRPAGTTAMFTCQAQGEPPPHVTWLKNGQVLGPGGHVRLKNNNSTLTISGIGPEDEAIYQCVAENSAGSSQASARLTVLWAEGLPGPPRNVRAVSVSSTEVRVSWSEPLANTKEIIGYVLHIRKAADPPELEYQEAVSKSTFQHLVSDLEPSTAYSFYIKAYTPRGASSASVPTLASTLGEAPAPPPLSVRVLGSSSLQLLWEPWPRLAQHEGGFKLFYRPASKTSFTGPILLPGTVSSYNLSQLDPTAVYEVKLLAYNQHGDGNATVRFVSLRGASERTALSPPCDCRKEEAANQTSTTG

SEQ ID NO: 2513 - protein, 957 aa, synthetic construct
  REGION 1..957: note = IGDCC4 (Q8TDY8) SP+PP+ECD
MARGDAGRGRGLLALTFCLLAARGELLLPQETTVELSCGVGPLQVILGPEQAAVLNCSLGAAAAGPPTRVTWSKDGDTLLEHDHLHLLPNGSLWLSQPLAPNGSDESVPEAVGVIEGNYSCLAHGPLGVLASQTAVVKLATLADFSLHPESQTVEENGTARFECHIEGLPAPIITWEKDQVTLPEEPRLIVLPNGVLQILDVQESDAGPYRCVATNSARQHFSQEALLSVAHRGSLASTRGQDVVIVAAPENTTVVSGQSVVMECVASADPTPFVSWVRQDGKPISTDVIVLGRTNLLIANAQPWHSGVYVCRANKPRTRDFATAAAELRVLAAPAITQAPEALSRTRASTARFVCRASGEPRPALRWLHNGAPLRPNGRVKVQGGGGSLVITQIGLQDAGYYQCVAENSAGMACAAASLAVVVREGLPSAPTRVTATPLSSSAVLVAWERPEMHSEQIIGFSLHYQKARGMDNVEYQFAVNNDTTELQVRDLEPNTDYEFYVVAYSQLGASRTSTPALVHTLDDVPSAAPQLSLSSPNPSDIRVAWLPLPPSLSNGQVVKYKIEYGLGKEDQIFSTEVRGNETQLMLNSLQPNKVYRVRISAGTAAGFGAPSQWMHHRTPSMHNQSHVPFAPAELKVQAKMESLVVSWQPPPHPTQISGYKLYWREVGAEEEANGDRLPGGRGDQAWDVGPVRLKKKVKQYELTQLVPGRLYEVKLVAFNKHEDGYAAVWKGKTEKAPAPDMPIQRGPPLPPAHVHAESNSSTSIWLRWKKPDFTTVKIVNYTVRFSPWGLRNASLVTYYTSSGEDILIGGLKPFTKYEFAVQSHGVDMDGPFGSVVERSTLPDRPSTPPSDLRLSPLTPSTVRLHWCPPTEPNGEIVEYLILYSSNHTQPEHQWTLLTTQGNIFSAEVHGLESDTRYFFKMGARTEVGPGPFSRLQDVITLQEKLSDSLDMHSVT

SEQ ID NO: 2514 - protein, 935 aa, synthetic construct
  REGION 1..935: note = IGF1R (P08069) SP+PP+ECD
MKSGSGGGSPTSLWGLLFLSAALSLWPTSGEICGPGIDIRNDYQQLKRLENCTVIEGYLHILLISKAEDYRSYRFPKLTVITEYLLLFRVAGLESLGDLFPNLTVIRGWKLFYNYALVIFEMTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECLGSCSAPDNDTACVACRHYYYAGVCVPACPPNTYRFEGWRCVDRDFCANILSAESSDSEGFVIHDGECMQECPSGFIRNGSQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTSKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIH

SEQ ID NO: 2515 - protein, 2304 aa, synthetic construct
  REGION 1..2304: note = IGF2R (P11717) SP+PP+ECD
MGAAAGRSPHLGPAPARRPQRSLLLLQLLLLVAAPGSTQAQAAPFPELCSYTWEAVDTKNNVLYKINICGSVDIVQCGPSSAVCMHDLKTRTYHSVGDSVLRSATRSLLEFNTTVSCDQQGTNHRVQSSIAFLCGKTLGTPEFVTATECVHYFEWRTTAACKKDIFKANKEVPCYVFDEELRKHDLNPLIKLSGAYLVDDSDPDTSLFINVCRDIDTLRDPGSQLRACPPGTAACLVRGHQAFDVGQPRDGLKLVRKDRLVLSYVREEAGKLDFCDGHSPAVTITFVCPSERREGTIPKLTAKSNCRYEIEWITEYACHRDYLESKTCSLSGEQQDVSIDLTPLAQSGGSSYISDGKEYLFYLNVCGETEIQFCNKKQAAVCQVKKSDTSQVKAAGRYHNQTLRYSDGDLTLIYFGGDECSSGFQRMSVINFECNKTAGNDGKGTPVFTGEVDCTYFFTWDTEYACVKEKEDLLCGATDGKKRYDLSALVRHAEPEQNWEAVDGSQTETEKKHFFINICHRVLQEGKARGCPEDAAVCAVDKNGSKNLGKFISSPMKEKGNIQLSYSDGDDCGHGKKIKTNITLVCKPGDLESAPVLRTSGEGGCFYEFEWHTAAACVLSKTEGENCTVFDSQAGFSFDLSPLTKKNGAYKVETKKYDFYINVCGPVSVSPCQPDSGACQVAKSDEKTWNLGLSNAKLSYYDGMIQLNYRGGTPYNNERHTPRATLITFLCDRDAGVGFPEYQEEDNSTYNFRWYTSYACPEEPLECVVTDPSTLEQYDLSSLAKSEGGLGGNWYAMDNSGEHVTWRKYYINVCRPLNPVPGCNRYASACQMKYEKDQGSFTEVVSISNLGMAKTGPVVEDSGSLLLEYVNGSACTTSDGRQTTYTTRIHLVCSRGRLNSHPIFSLNWECVVSFLWNTEAACPIQTTTDTDQACSIRDPNSGFVFNLNPLNSSQGYNVSGIGKIFMFNVCGTMPVCGTILGKPASGCEAETQTEELKNWKPARPVGIEKSLQLSTEGFITLTYKGPLSAKGTADAFIVRFVCNDDVYSGPLKFLHQDIDSGQGIRNTYFEFETALACVPSPVDCQVTDLAGNEYDLTGLSTVRKPWTAVDTSVDGRKRTFYLSVCNPLPYIPGCQGSAVGSCLVSEGNSWNLGVVQMSPQAAANGSLSIMYVNGDKCGNQRFSTRITFECAQISGSPAFQLQDGCEYVFIWRTVEACPVVRVEGDNCEVKDPRHGNLYDLKPLGLNDTIVSAGEYTYYFRVCGKLSSDVCPTSDKSKVVSSCQEKREPQGFHKVAGLLTQKLTYENGLLKMNFTGGDTCHKVYQRSTAIFFYCDRGTQRPVFLKETSDCSYLFEWRTQYACPPFDLTECSFKDGAGNSFDLSSLSRYSDNWEAITGTGDPEHYLINVCKSLAPQAGTEPCPPEAAACLLGGSKPVNLGRVRDGPQWRDGIIVLKYVDGDLCPDGIRKKSTTIRFTCSESQVNSRPMFISAVEDCEYTFAWPTATACPMKSNEHDDCQVTNPSTGHLFDLSSLSGRAGFTAAYSEKGLVYMSICGENENCPPGVGACFGQTRISVGKANKRLRYVDQVLQLVYKDGSPCPSKSGLSYKSVISFVCRPEARPTNRPMLISLDKQTCTLFFSWHTPLACEQATECSVRNGSSIVDLSPLIHRTGGYEAYDESEDDASDTNPDFYINICQPLNPMHGVPCPAGAAVCKVPIDGPPIDIGRVAGPPILNPIANEIYLNFESSTPCLADKHFNYTSLIAFHCKRGVSMGTPKLLRTSECDFVFEWETPVVCPDEVRMDGCTLTDEQLLYSFNLSSLSTSTFKVTRDSRTYSVGVCTFAVGPEQGGCKDGGVCLLSGTKGASFGRLQSMKLDYRHQDEAVVLSYVNGDRCPPETDDGVPCVFPFIFNGKSYEECIIESRAKLWCSTTADYDRDHEWGFCRHSNSYRTSSIIFKCDEDEDIGRPQVFSEVRGCDVTFEWKTKVVCPPKKLECKFVQKHKTYDLRLLSSLTGSWSLVHNGVSYYINLCQKIYKGPLGCSERASICRRTTTGDVQVLGLVHTQKLGVIGDKVVVTYSKGYPCGGNKTASSVIELTCTKTVGRPAFKRFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGVGFDSENPGDDGQMHKGLSERSQ

SEQ ID NO: 2516 - protein, 163 aa, synthetic construct
  REGION 1..163: note = IGFLR1 (Q9H665) SP+PP+ECD
MGPGRCLLTALLLLALAPPPEASQYCGRLEYWNPDNKCCSSCLQRFGPPPCPDYEFRENCGLNDHGDFVTPPFRKCSSGQCNPDGAELCSPCGGGAVTPTPAAGGGRTPWRCRERPVPAKGHCPLTPGNPGAPSSQERSSPASSIAWRTPEPVPQQAWPNFLP

SEQ ID NO: 2517 - protein, 241 aa, synthetic construct
  REGION 1..241: note = IGSF11 (Q5DX21) SP+PP+ECD
MTSQRSPLAPLLLLSLHGVAASLEVSESPGSIQVARGQPAVLPCTFTTSAALINLNVIWMVTPLSNANQPEQVILYQGGQMFDGAPRFHGRVGFTGTMPATNVSIFINNTQLSDTGTYQCLVNNLPDIGGRNIGVTGLTVLVPPSAPHCQIQGSQDIGSDVILLCSSEEGIPRPTYLWEKLDNTLKLPPTATQDQVQGTVTIRNISALSSGLYQCVASNAIGTSTCLLDLQVISPQPRNIG

SEQ ID NO: 2518 - protein, 1124 aa, synthetic construct
  REGION 1..1124: note = IGSF3 (O75054) SP+PP+ECD
MKCFFPVLSCLAVLGVVSAQRQVTVQEGPLYRTEGSHITIWCNVSGYQGPSEQNFQWSIYLPSSPEREVQIVSTMDSSFPYAIYTQRVRGGKIFIERVQGNSTLLHITDLQARDAGEYECHTPSTDKQYFGSYSAKMNLVVIPDSLQTTAMPQTLHRVEQDPLELTCEVASETIQHSHLSVAWLRQKVGEKPVEVISLSRDFMLHSSSEYAQRQSLGEVRLDKLGRTTFRLTIFHLQPSDQGEFYCEAAEWIQDPDGSWYAMTRKRSEGAVVNVQPTDKEFTVRLETEKRLHTVGEPVEFRCILEAQNVPDRYFAVSWAFNSSLIATMGPNAVPVLNSEFAHREARGQLKVAKESDSVFVLKIYHLRQEDSGKYNCRVTEREKTVTGEFIDKESKRPKNIPIIVLPLKSSISVEVASNASVILEGEDLRFSCSVRTAGRPQGRFSVIWQLVDRQNRRSNIMWLDRDGTVQPGSSYWERSSFGGVQMEQVQPNSFSLGIFNSRKEDEGQYECHVTEWVRAVDGEWQIVGERRASTPISITALEMGFAVTAISRTPGVTYSDSFDLQCIIKPHYPAWVPVSVTWRFQPVGTVEFHDLVTFTRDGGVQWGDRSSSFRTRTAIEKAESSNNVRLSISRASDTEAGKYQCVAELWRKNYNNTWTRLAERTSNLLEIRVLQPVTKLQVSKSKRTLTLVENKPIQLNCSVKSQTSQNSHFAVLWYVHKPSDADGKLILKTTHNSAFEYGTYAEEEGLRARLQFERHVSGGLFSLTVQRAEVSDSGSYYCHVEEWLLSPNYAWYKLAEEVSGRTEVTVKQPDSRLRLSQAQGNLSVLETRQVQLECVVLNRTSITSQLMVEWFVWKPNHPERETVARLSRDATFHYGEQAAKNNLKGRLHLESPSPGVYRLFIQNVAVQDSGTYSCHVEEWLPSPSGMWYKRAEDTAGQTALTVMRPDASLQVDTVVPNATVSEKAAFQLDCSIVSRSSQDSRFAVAWYSLRTKAGGKRSSPGLEEQEEEREEEEEEDDDDDDDPTERTALLSVGPDAVFGPEGSPWEGRLRFQRLSPVLYRLTVLQASPQDTGNYSCHVEEWLPSPQKEWYRLTEEESAPIGIRVLDTSPTLQSIICSNDA

SEQ ID NO: 2519 - protein, 153 aa, synthetic construct
  REGION 1..153: note = IGSF6 (O95976) SP+PP+ECD
MGTASRSNIARHLQTNLILFCVGAVGACTLSVTQPWYLEVDYTHEAVTIKCTFSATGCPSEQPTCLWFRYGAHQPENLCLDGCKSEADKFTVREALKENQVSLTVNRVTSNDSAIYICGIAFPSVPEARAKQTGGGTTLVVREIKLLSKELRS

SEQ ID NO: 2520 - protein, 579 aa, synthetic construct
  REGION 1..579: note = IGSF8 (Q969P0) SP+PP+ECD
MGALRPTLLPPSLPLLLLLMLGMGCWAREVLVPEGPLYRVAGTAVSISCNVTGYEGPAQQNFEWFLYRPEAPDTALGIVSTKDTQFSYAVFKSRVVAGEVQVQRLQGDAVVLKIARLQAQDAGIYECHTPSTDTRYLGSYSGKVELRVLPDVLQVSAAPPGPRGRQAPTSPPRMTVHEGQELALGCLARTSTQKHTHLAVSFGRSVPEAPVGRSTLQEVVGIRSDLAVEAGAPYAERLAAGELRLGKEGTDRYRMVVGGAQAGDAGTYHCTAAEWIQDPDGSWAQIAEKRAVLAHVDVQTLSSQLAVTVGPGERRIGPGEPLELLCNVSGALPPAGRHAAYSVGWEMAPAGAPGPGRLVAQLDTEGVGSLGPGYEGRHIAMEKVASRTYRLRLEAARPGDAGTYRCLAKAYVRGSGTRLREAASARSRPLPVHVREEGVVLEAVAWLAGGTVYRGETASLLCNISVRGGPPGLRLAASWWVERPEDGELSSVPAQLVGGVGQDGVAELGVRPGGGPVSVELVGPRSHRLRLHSLGPEDEGVYHCAPSAWVQHADYSWYQAGSARSGPVTVYPYMHALDT

SEQ ID NO: 2521 - protein, 734 aa, synthetic construct
  REGION 1..734: note = IGSF9 (Q9P2J2) SP+PP+ECD
MVWCLGLAVLSLVISQGADGRGKPEVVSVVGRAGESVVLGCDLLPPAGRPPLHVIEWLRFGFLLPIFIQFGLYSPRIDPDYVGRVRLQKGASLQIEGLRVEDQGWYECRVFFLDQHIPEDDFANGSWVHLTVNSPPQFQETPPAVLEVQELEPVTLRCVARGSPLPHVTWKLRGKDLGQGQGQVQVQNGTLRIRRVERGSSGVYTCQASSTEGSATHATQLLVLGPPVIVVPPKNSTVNASQDVSLACHAEAYPANLTYSWFQDNINVFHISRLQPRVRILVDGSLRLLATQPDDAGCYTCVPSNGLLHPPSASAYLTVLYPAQVTAMPPETPLPIGMPGVIRCPVRANPPLLFVSWTKDGKALQLDKFPGWSQGTEGSLIIALGNEDALGEYSCTPYNSLGTAGPSPVTRVLLKAPPAFIERPKEEYFQEVGRELLIPCSAQGDPPPVVSWTKVGRGLQGQAQVDSNSSLILRPLTKEAHGHWECSASNAVARVATSTNVYVLGTSPHVVTNVSVVALPKGANVSWEPGFDGGYLQRFSVWYTPLAKRPDRMHHDWVSLAVPVGAAHLLVPGLQPHTQYQFSVLAQNKLGSGPFSEIVLSAPEGLPTTPAAPGLPPTEIPPPLSPPRGLVAVRTPRGVLLHWDPPELVPKRLDGYVLEGRQGSQGWEVLDPAVAGTETELLVPGLIKDVLYEFRLVAFAGSFVSDPSNTANVSTSGLEVYPSRTQLPGLLPQP

SEQ ID NO: 2522 - protein, 722 aa, synthetic construct
  REGION 1..722: note = IGSF9B (Q9UPX0) SP+PP+ECD
MIWYVATFIASVIGTRGLAAEGAHGLREEPEFVTARAGESVVLRCDVIHPVTGQPPPYVVEWFKFGVPIPIFIKFGYYPPHVDPEYAGRASLHDKASLRLEQVRSEDQGWYECKVLMLDQQYDTFHNGSWVHLTINAPPTFTETPPQYIEAKEGGSITMTCTAFGNPKPIVTWLKEGTLLGASGKYQVSDGSLTVTSVSREDRGAYTCRAYSIQGEAVHTTHLLVQGPPFIVSPPENITVNISQDALLTCRAEAYPGNLTYTWYWQDENVYFQNDLKLRVRILIDGTLIIFRVKPEDSGKYTCVPSNSLGRSPSASAYLTVQYPARVLNMPPVIYVPVGIHGYIRCPVDAEPPATVVKWNKDGRPLQVEKNLGWTLMEDGSIRIEEATEEALGTYTCVPYNTLGTMGQSAPARLVLKDPPYFTVLPGWEYRQEAGRELLIPCAAAGDPFPVITWRKVGKPSRSKHSALPSGSLQFRALSKEDHGEWECVATNVVTSITASTHLTVIGTSPHAPGSVRVQVSMTTANVSWEPGYDGGYEQTFSVWMKRAQFGPHDWLSLPVPPGPSWLLVDTLEPETAYQFSVLAQNKLGTSAFSEVVTVNTLAFPITTPEPLVLVTPPRCLIANRTQQGVLLSWLPPANHSFPIDRYIMEFRVAERWELLDDGIPGTEGEFFAKDLSQDTWYEFRVLAVMQDLISEPSNIAGVSSTDIFPQPDLTEDGLARP

SEQ ID NO: 2523 - protein, 235 aa, synthetic construct
  REGION 1..235: note = IL10RA (Q13651) SP+PP+ECD
MLPCLVVLLAALLSLRLGSDAHGTELPSPPSVWFEAEFFHHILHWTPIPNQSESTCYEVALLRYGIESWNSISNCSQTLSYDLTAVTLDLYHSNGYRARVRAVDGSRHSNWTVTNTRFSVDEVTLTVGSVNLEIHNGFILGKIQLPRPKMAPANDTYESIFSHFREYEIAIRKVPGNFTFTHKKVKHENFSLLTSGEVGEFCVQVKPSVASRSNKGMWSKEECISLTRQYFTVTN

SEQ ID NO: 2524 - protein, 220 aa, synthetic construct
  REGION 1..220: note = IL10RB (Q08334) SP+PP+ECD
MAWSLGSWLGGCLLVSALGMVPPPENVRMNSVNFKNILQWESPAFAKGNLTFTAQYLSYRIFQDKCMNTTLTECDFSSLSKYGDHTLRVRAEFADEHSDWVNITFCPVDDTIIGPPGMQVEVLADSLHMRFLAPKIENEYETWTMKNVYNSWTYNVQYWKNGTDEKFQITPQYDFEVLRNLEPWTTYCVQVRGFLPDRNKAGEWSEPVCEQTTHDETVPS

SEQ ID NO: 2525 - protein, 369 aa, synthetic construct
  REGION 1..369: note = IL11RA (Q14626) SP+PP+ECD
MSSSCSGLSRVLVAVATALVSASPCPQAWGPPGVQYGQPGRSVKLCCPGVTAGDPVSWFRDGEPKLLQGPDSGLGHELVLAQADSTDEGTYICQTLDGALGGTVTLQLGYPPARPVVSCQAADYENFSCTWSPSQISGLPTRYLTSYRKKTVLGADSQRRSPSTGPWPCPQDPLGAARCVVHGAEFWSQYRINVTEVNPLGASTRLLDVSLQSILRPDPPQGLRVESVPGYPRRLRASWTYPASWPCQPHFLLKFRLQYRPAQHPAWSTVEPAGLEEVITDAVAGLPHAVRVSARDFLDAGTWSTWSPEAWGTPSTGTIPKEIPAWGQLHTQPEVEPQVDSPAPPRPSLQPHPRLLDHRDSVEQVAVLA

SEQ ID NO: 2526 - protein, 545 aa, synthetic construct
  REGION 1..545: note = IL12RB1 (P42701) SP+PP+ECD
MEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEHPVQPTETQVTLSGLRAGVAYTVQVRADTAWLRGVWSQPQRFSIEVQVSD

SEQ ID NO: 2527 - protein, 622 aa, synthetic construct
  REGION 1..622: note = IL12RB2 (Q99665) SP+PP+ECD
MAHTFRGCSLAFMFIITWLLIKAKIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKNLSVSEARGKILHYQVTLQELTGGKAMTQNITGHTSWTTVIPRTGNWAVAVSAANSKGSSLPTRINIMNLCEAGLLAPRQVSANSEGMDNILVTWQPPRKDPSAVQEYVVEWRELHPGGDTQVPLNWLRSRPYNVSALISENIKSYICYEIRVYALSGDQGGCSSILGNSKHKAPLSGPHINAITEEKGSILISWNSIPVQEQMGCLLHYRIYWKERDSNSQPQLCEIPYRVSQNSHPINSLQPRVTYVLWMTALTAAGESSHGNEREFCLQGKAN

SEQ ID NO: 2528 - protein, 343 aa, synthetic construct
  REGION 1..343: note = IL13RA1 (P78552) SP+PP+ECD
MEWPARLCGLWALLLCAGGGGGGGGAAPTETQPPVTNLSVSVENLCTVIWTWNPPEGASSNCSLWYFSHFGDKQDKKIAPETRRSIEVPLNERICLQVGSQCSTNESEKPSILVEKCISPPEGDPESAVTELQCIWHNLSYMKCSWLPGRNTSPDTNYTLYYWHRSLEKIHQCENIFREGQYFGCSFDLTKVKDSSFEQHSVQIMVKDNAGKIKPSFNIVPLTSRVKPDPPHIKNLSFHNDDLYVQWENPQNFISRCLFYEVEVNNSQTETHNVFYVQEAKCENPEFERNVENTSCFMVPGVLPDTLNTVRIRVKTNKLCYEDDKLWSNWSQEMSIGKKRNST

SEQ ID NO: 2529 - protein, 343 aa, synthetic construct
  REGION 1..343: note = IL13RA2 (Q14627) SP+PP+ECD
MAFVCLAIGCLYTFLISTTFGCTSSSDTEIKVNPPQDFEIVDPGYLGYLYLQWQPPLSLDHFKECTVEYELKYRNIGSETWKTIITKNLHYKDGFDLNKGIEAKIHTLLPWQCTNGSEVQSSWAETTYWISPQGIPETKVQDMDCVYYNWQYLLCSWKPGIGVLLDTNYNLFYWYEGLDHALQCVDYIKADGQNIGCRFPYLEASDYKDFYICVNGSSENKPIRSSYFTFQLQNIVKPLPPVYLTFTRESSCEIKLKWSIPLGPIPARCFDYEIEIREDDTTLVTATVENETYTLKTTNETRQLCFVVRSKVNIYCSDDGIWSEWSDKQCWEGEDLSKKTLLR

SEQ ID NO: 2530 - protein, 205 aa, synthetic construct
  REGION 1..205: note = IL15RA (Q13261) SP+PP+ECD
MAPRRARGCRTLGLPALLLLLLLRPPATRGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTT

SEQ ID NO: 2531 - protein, 320 aa, synthetic construct
  REGION 1..320: note = IL17RA (Q96F46) SP+PP+ECD
MGAARSPPSAVPGPLLGLLLLLLGVLAPGGASLRLLDHRALVCSQPGLNCTVKNSTCLDDSWIHPRNLTPSSPKDLQIQLHFAHTQQGDLFPVAHIEWTLQTDASILYLEGAELSVLQLNTNERLCVRFEFLSKLRHHHRRWRFTFSHFVVDPDQEYEVTVHHLPKPIPDGDPNHQSKNFLVPDCEHARMKVTTPCMSSGSLWDPNITVETLEAHQLRVSFTLWNESTHYQILLTSFPHMENHSCFEHMHHIPAPRPEEFHQRSNVTLTLRNLKGCCRHQVQIQPFFSSCLNDCLRHSATVSCPEMPDTPEPIPDYMPLW

SEQ ID NO: 2532 - protein, 292 aa, synthetic construct
  REGION 1..292: note = IL17RB (Q9NRM6) SP+PP+ECD
MSLVLLSLAALCRSAVPREPTVQCGSETGPSPEWMLQHDLIPGDLRDLRVEPVTTSVATGDYSILMNVSWVLRADASIRLLKATKICVTGKSNFQSYSCVRCNYTEAFQTQTRPSGGKWTFSYIGFPVELNTVYFIGAHNIPNANMNEDGPSMSVNFTSPGCLDHIMKYKKKCVKAGSLWDPNITACKKNEETVEVNFTTTPLGNRYMALIQHSTIIGFSQVFEPHQKKQTRASVVIPVTGDSEGATVQLTPYFPTCGSDCIRHKGTVVLCPQTGVPFPLDNNKSKPGGWLP

SEQ ID NO: 2533 - protein, 538 aa, synthetic construct
  REGION 1..538: note = IL17RC (Q8NAC3) SP+PP+ECD
MPVPWFLLSLALGRSPVVLSLERLVGPQDATHCSPVSLEPWGDEERLRVQFLAQQSLSLAPVTAATARTALSGLSGADGRREERGRGKSWVCLSLGGSGNTEPQKKGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPDCRGLEVWNSIPSCWALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLQLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKR

SEQ ID NO: 2534 - protein, 299 aa, synthetic construct
  REGION 1..299: note = IL17RD (Q8NFM7) SP+PP+ECD
MAPWLQLCSVFFTVNACLNGSQLAVAAGGSGRARGADTCGWRGVGPASRNSGLYNITFKYDNCTTYLNPVGKHVIADAQNITISQYACHDQVAVTILWSPGALGIEFLKGFRVILEELKSEGRQCQQLILKDPKQLNSSFKRTGMESQPFLNMKFETDYFVKVVPFPSIKNESNYHPFFFRTRACDLLLQPDNLACKPFWKPRNLNISQHGSDMQVSFDHAPHNFGFRFFYLHYKLKHEGPFKRKTCKQEQTTETTSCLLQNVSPGDYIIELVDDTNTTRKVMHYALKPVHSPWAGPIR

SEQ ID NO: 2535 - protein, 454 aa, synthetic construct
  REGION 1..454: note = IL17RE (Q8NFR9) SP+PP+ECD
MGSSRLAALLLPLLLIVIDLSDSAGIGFRHLPHWNTRCPLASHTDDSFTGSSAYIPCRTWWALFSTKPWCVRVWHCSRCLCQHLLSGGSGLQRGLFHLLVQKSKKSSTFKFYRRHKMPAPAQRKLLPRRHLSEKSHHISIPSPDISHKGLRSKRTQPSDPETWESLPRLDSQRHGGPEFSFDLLPEARAIRVTISSGPEVSVRLCHQWALECEELSSPYDVQKIVSGGHTVELPYEFLLPCLCIEASYLQEDTVRRKKCPFQSWPEAYGSDFWKSVHFTDYSQHTQMVMALTLRCPLKLEAALCQRHDWHTLCKDLPNATARESDGWYVLEKVDLHPQLCFKFSFGNSSHVECPHQTGSLTSWNVSMDTQAQQLILHFSSRMHATFSAAWSLPGLGQDTLVPPVYTVSQARGSSPVSLDLIIPFLRPGCCVLVWRSDVQFAWKHLLCPDVSYRH

SEQ ID NO: 2536 - protein, 329 aa, synthetic construct
  REGION 1..329: note = IL18R1 (Q13478) SP+PP+ECD
MNCRELPLTLWVLISVSTAESCTSRPHITVVEGEPFYLKHCSCSLAHEIETTTKSWYKSSGSQEHVELNPRSSSRIALHDCVLEFWPVELNDTGSYFFQMKNYTQKWKLNVIRRNKHSCFTERQVTSKIVEVKKFFQITCENSYYQTLVNSTSLYKNCKKLLLENNKNPTIKKNAEFEDQGYYSCVHFLHHNGKLFNITKTFNITIVEDRSNIVPVLLGPKLNHVAVELGKNVRLNCSALLNEEDVIYWMFGEENGSDPNIHEEKEMRIMTPEGKWHASKVLRIENIGESNLNVLYNCTVASTGGTDTKSFILVRKADMADIPGHVFTR

SEQ ID NO: 2537 - protein, 356 aa, synthetic construct
  REGION 1..356: note = IL18RAP (O95256) SP+PP+ECD
MLCLGWIFLWLVAGERIKGFNISGCSTKKLLWTYSTRSEEEFVLFCDLPEPQKSHFCHRNRLSPKQVPEHLPFMGSNDLSDVQWYQQPSNGDPLEDIRKSYPHIIQDKCTLHFLTPGVNNSGSYICRPKMIKSPYDVACCVKMILEVKPQTNASCEYSASHKQDLLLGSTGSISCPSLSCQSDAQSPAVTWYKNGKLLSVERSNRIVVDEVYDYHQGTYVCDYTQSDTVSSWTVRAVVQVRTIVGDTKLKPDILDPVEDTLEVELGKPLTISCKARFGFERVFNPVIKWYIKDSDLEWEVSVPEAKSIKSTLKDEIIERNIILEKVTQRDLRRKFVCFVQNSIGNTTQSVQLKEKR

SEQ ID NO: 2538 - protein, 336 aa, synthetic construct
  REGION 1..336: note = IL1R1 (P14778) SP+PP+ECD
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFVENEPNLCYNAQAIFKQKLPVAGDGGLVCPYMEFFKNENNELPKLQWYKDCKPLLLDNIHFSGVKDRLIVMNVAEKHRGNYTCHASYTYLGKQYPITRVIEFITLEENKPTRPVIVSPANETMEVDLGSQIQLICNVTGQLSDIAYWKWNGSVIDEDDPVLGEDYYSVENPANKRRSTLITVLNISEIESRFYKHPFTCFAKNTHGIDAAYIQLIYPVTNFQK

SEQ ID NO: 2539 - protein, 343 aa, synthetic construct
  REGION 1..343: note = IL1R2 (P27930) SP+PP+ECD
MLRLYVLVMGVSAFTLQPAAHTGAARSCRFRGRHYKREFRLEGEPVALRCPQVPYWLWASVSPRINLTWHKNDSARTVPGEEETRMWAQDGALWLLPALQEDSGTYVCTTRNASYCDKMSIELRVFENTDAFLPFISYPQILTLSTSGVLVCPDLSEFTRDKTDVKIQWYKDSLLLDKDNEKFLSVRGTTHLLVHDVALEDAGYYRCVLTFAHEGQQYNITRSIELRIKKKKEETIPVIISPLKTISASLGSRLTIPCKVFLGTGTPLTTMLWWTANDTHIESAYPGGRVTEGPRQEYSENNENYIEVPLIFDPVTREDLHMDFKCVVHNTLSFQTLRTTVKE

SEQ ID NO: 2540 - protein, 367 aa, synthetic construct
  REGION 1..367: note = IL1RAP (Q9NPH3) SP+PP+ECD
MTLLWCVVSLYFYGILQSDASERCDDWGLDTMRQIQVFEDEPARIKCPLFEHFLKFNYSTAHSAGLTLIWYWTRQDRDLEEPINFRLPENRISKEKDVLWFRPTLLNDTGNYTCMLRNTTYCSKVAFPLEVVQKDSCFNSPMKLPVHKLYIEYGIQRITCPNVDGYFPSSVKPTITWYMGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVKQKVPAPRYTVELACGFGAT

SEQ ID NO: 2541 - protein, 357 aa, synthetic construct
  REGION 1..357: note = IL1RAPL1 (Q9NZN1) SP+PP+ECD
MKAPIPHLILLYATFTQSLKVVTKRGSADGCTDWSIDIKKYQVLVGEPVRIKCALFYGYIRTNYSLAQSAGLSLMWYKSSGPGDFEEPIAFDGSRMSKEEDSIWFRPTLLQDSGLYACVIRNSTYCMKVSISLTVGENDTGLCYNSKMKYFEKAELSKSKEISCRDIEDFLLPTREPEILWYKECRTKTWRPSIVFKRDTLLIREVREDDIGNYTCELKYGGFVVRRTTELTVTAPLTDKPPKLLYPMESKLTIQETQLGDSANLTCRAFFGYSGDVSPLIYWMKGEKFIEDLDENRVWESDIRILKEHLGEQEVSISLIVDSVEEGDLGNYSCYVENGNGRRHASVLLHKRELMYT

SEQ ID NO: 2542 - protein, 354 aa, synthetic construct
  REGION 1..354: note = IL1RAPL2 (Q9NP60) SP+PP+ECD
MKPPFLLALVVCSVVSTNLKMVSKRNSVDGCIDWSVDLKTYMALAGEPVRVKCALFYSYIRTNYSTAQSTGLRLMWYKNKGDLEEPIIFSEVRMSKEEDSIWFHSAEAQDSGFYTCVLRNSTYCMKVSMSLTVAENESGLCYNSRIRYLEKSEVTKRKEISCPDMDDFKKSDQEPDVVWYKECKPKMWRSIIIQKGNALLIQEVQEEDGGNYTCELKYEGKLVRRTTELKVTALLTDKPPKPLFPMENQPSVIDVQLGKPLNIPCKAFFGFSGESGPMIYWMKGEKFIEELAGHIREGEIRLLKEHLGEKEVELALIFDSVVEADLANYTCHVENRNGRKHASVLLRKKDLIYK

SEQ ID NO: 2543 - protein, 328 aa, synthetic construct
  REGION 1..328: note = IL1RL1 (Q01638) SP+PP+ECD
MGFWILAILTILMYSTAAKFSKQSWGLENEALIVRCPRQGKPSYTVDWYYSQTNKSIPTQERNRVFASGQLLKFLPAAVADSGIYTCIVRSPTFNRTGYANVTIYKKQSDCNVPDYLMYSTVSGSEKNSKIYCPTIDLYNWTAPLEWFKNCQALQGSRYRAHKSFLVIDNVMTEDAGDYTCKFIHNENGANYSVTATRSFTVKDEQGFSLFPVIGAPAQNEIKEVEIGKNANLTCSACFGKGTQFLAAVLWQLNGTKITDFGEPRIQQEEGQNQSFSNGLACLDMVLRIADVKEEDLLLQYDCLALNLHGLRRHTVRLSRKNPIDHHS

SEQ ID NO: 2544 - protein, 335 aa, synthetic construct
  REGION 1..335: note = IL1RL2 (Q9HB29) SP+PP+ECD
MWSLLLCGLSIALPLSVTADGCKDIFMKNEILSASQPFAFNCTFPPITSGEVSVTWYKNSSKIPVSKIIQSRIHQDETWILFLPMEWGDSGVYQCVIKGRDSCHRIHVNLTVFEKHWCDTSIGGLPNLSDEYKQILHLGKDDSLTCHLHFPKSCVLGPIKWYKDCNEIKGERFTVLETRLLVSNVSAEDRGNYACQAILTHSGKQYEVLNGITVSITERAGYGGSVPKIIYPKNHSIEVQLGTTLIVDCNVTDTKDNTNLRCWRVNNTLVDDYYDESKRIREGVETHVSFREHNLYTVNITFLEVKMEDYGLPFMCHAGVSTAYIILQLPAPDFR

SEQ ID NO: 2545 - protein, 250 aa, synthetic construct
  REGION 1..250: note = IL20RA (Q9UHF4) SP+PP+ECD
MRAPGRPALRPLPLPPLLLLLLAAPWGRAVPCVSGGLPKPANITFLSINMKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAK

SEQ ID NO: 2546 - protein, 233 aa, synthetic construct
  REGION 1..233: note = IL20RB (Q6UXL0) SP+PP+ECD
MQTFTMVLEEIWTSLFMWFFYALIPCLLTDEVAILPAPQNLSVLSTNMKHLLMWSPVIAPGETVYYSVEYQGEYESLYTSHIWIPSSWCSLTEGPECDVTDDITATVPYNLRVRATLGSQTSAWSILKHPFNRNSTILTRPGMEITKDGFHLVIELEDLGPQFEFLVAYWRREPGAEEHVKMVRSGGIPVHLETMEPGAAYCVKAQTFVKAIGRYSAFSQTECVEVQGEAIPL

SEQ ID NO: 2547 - protein, 232 aa, synthetic construct
  REGION 1..232: note = IL21R (Q9HBE5) SP+PP+ECD
MPRGWAAPLLLLLLQGGWGCPDLVCYTDYLQTVICILEMWNLHPSTLTLTWQDQYEELKDEATSCSLHRSAHNATHATYTCHMDVFHFMADDIFSVNITDQSGNYSQECGSFLLAESIKPAPPFNVTVTFSGQYNISWRSDYEDPAFYMLKGKLQYELQYRNRGDPWAVSPRRKLISVDSRSVSLLPLEFRKDSSYELQVRAGPMPGSSYQGTWSEWSDPVIFQTQSEELKE

SEQ ID NO: 2548 - protein, 228 aa, synthetic construct
  REGION 1..228: note = IL22RA1 (Q8N6P7) SP+PP+ECD
MRTLLTILTVGSLAAHAPEDPSDLLQHVKFQSSNFENILTWDSGPEGTPDTVYSIEYKTYGERDWVAKKGCQRITRKSCNLTVETGNLTELYYARVTAVSAGGRSATKMTDRFSSLQHTTLKPPDVTCISKVRSIQMIVHPTPTPIRAGDGHRLTLEDIFHDLFYHLELQVNRTYQMHLGGKQREYEFFGLTPDTEFLGTIMICVPTWAKESAPYMCRVKTLPDRTWT

SEQ ID NO: 2549 - protein, 355 aa, synthetic construct
  REGION 1..355: note = IL23R (Q5VWK5) SP+PP+ECD
MNQVTIQWDAVIALYILFSWCHGGITNINCSGHIWVEPATIFKMGMNISIYCQAAIKNCQPRKLHFYKNGIKERFQITRINKTTARLWYKNFLEPHASMYCTAECPKHFQETLICGKDISSGYPPDIPDEVTCVIYEYSGNMTCTWNAGKLTYIDTKYVVHVKSLETEEEQQYLTSSYINISTDSLQGGKKYLVWVQAANALGMEESKQLQIHLDDIVIPSAAVISRAETINATVPKTIIYWDSQTTIEKVSCEMRYKATTNQTWNVKEFDTNFTYVQQSEFYLEPNIKYVFQVRCQETGKRYWQPWSSLFFHKTPETVPQVTSKAFQHDTWNSGLTVASISTGHLTSDNRGDIG

SEQ ID NO: 2550 - protein, 516 aa, synthetic construct
  REGION 1..516: note = IL27RA (Q6UWB1) SP+PP+ECD
MRGGRGAPFWLWPLPKLALLPLLWVLFQRTRPQGSAGPLQCYGVGPLGDLNCSWEPLGDLGAPSELHLQSQKYRSNKTQTVAVAAGRSWVAIPREQLTMSDKLLVWGTKAGQPLWPPVFVNLETQMKPNAPRLGPDVDFSEDDPLEATVHWAPPTWPSHKVLICQFHYRRCQEAAWTLLEPELKTIPLTPVEIQDLELATGYKVYGRCRMEKEEDLWGEWSPILSFQTPPSAPKDVWVSGNLCGTPGGEEPLLLWKAPGPCVQVSYKVWFWVGGRELSPEGITCCCSLIPSGAEWARVSAVNATSWEPLTNLSLVCLDSASAPRSVAVSSIAGSTELLVTWQPGPGEPLEHVVDWARDGDPLEKLNWVRLPPGNLSALLPGNFTVGVPYRITVTAVSASGLASASSVWGFREELAPLVGPTLWRLQDAPPGTPAIAWGEVPRHQLRGHLTHYTLCAQSGTSPSVCMNVSGNTQSVTLPDLPWGPCELWVTASTIAGQGPPGPILRLHLPDNTLRWK

SEQ ID NO: 2551 - protein, 240 aa, synthetic construct
  REGION 1..240: note = IL2RA (P01589) SP+PP+ECD
MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQ

SEQ ID NO: 2552 - protein, 240 aa, synthetic construct
  REGION 1..240: note = IL2RB (P14784) SP+PP+ECD
MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDT

SEQ ID NO: 2553 - protein, 262 aa, synthetic construct
  REGION 1..262: note = IL2RG (P31785) SP+PP+ECD
MLKPSLPFTSLLFLQLPLLGVGLNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEA

SEQ ID NO: 2554 - protein, 519 aa, synthetic construct
  REGION 1..519: note = IL31RA (Q8NI17) SP+PP+ECD
MMWTWALWMLPSLCKFSLAALPAKPENISCVYYYRKNLTCTWSPGKETSYTQYTVKRTYAFGEKHDNCTTNSSTSENRASCSFFLPRITIPDNYTIEVEAENGDGVIKSHMTYWRLENIAKTEPPKIFRVKPVLGIKRMIQIEWIKPELAPVSSDLKYTLRFRTVNSTSWMEVNFAKNRKDKNQTYNLTGLQPFTEYVIALRCAVKESKFWSDWSQEKMGMTEEEAPCGLELWRVLKPAEADGRRPVRLLWKKARGAPVLEKTLGYNIWYYPESNTNLTETMNTTNQQLELHLGGESFWVSMISYNSLGKSPVATLRIPAIQEKSFQCIEVMQACVAEDQLVVKWQSSALDVNTWMIEWFPDVDSEPTTLSWESVSQATNWTIQQDKLKPFWCYNISVYPMLHDKVGEPYSIQAYAKEGVPSEGPETKVENIGVKTVTITWKEIPKSERKGIICNYTIFYQAEGGKGFSKTVNSSILQYGLESLKRKTSYIVQVMASTSAGGTNGTSINFKTLSFSVFE

SEQ ID NO: 2555 - protein, 305 aa, synthetic construct
  REGION 1..305: note = IL3RA (P26951) SP+PP+ECD
MVLLWLTLLLIALPCLLQTKEDPNPPITNLRMKAKAQQLTWDLNRNVTDIECVKDADYSMPAVNNSYCQFGAISLCEVTNYTVRVANPPFSTWILFPENSGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGANTRAWR

SEQ ID NO: 2556 - protein, 232 aa, synthetic construct
  REGION 1..232: note = IL4R (P24394) SP+PP+ECD
MGWLCSGLLFPVSCLVLLQVASSGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSYREPFEQH

SEQ ID NO: 2557 - protein, 342 aa, synthetic construct
  REGION 1..342: note = IL5RA (Q01344) SP+PP+ECD
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIACWFPRTFILSKGRDWLAVLVNGSSKHSAIRPFDQLFALHAIDQINPPLNVTAEIEGTRLSIQWEKPVSAFPIHCFDYEVKIHNTRNGYLQIEKLMTNAFISIIDDLSKYDVQVRAAVSSMCREAGLWSEWSQPIYVGNDEHKPLREW

SEQ ID NO: 2558 - protein, 365 aa, synthetic construct
  REGION 1..365: note = IL6R (P08887) SP+PP+ECD
MLAVGCALLAALLAAPGAALAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPAENEVSTPMQALTTNKDDDNILFRDSANATSLPVQDSSSVPLP

SEQ ID NO: 2559 - protein, 619 aa, synthetic construct
  REGION 1..619: note = IL6ST (P40189) SP+PP+ECD
MLTLQTWLVQALFIFLTTESTGELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGLPPEKPKNLSCIVNEGKKMRCEWDGGRETHLETNFTLKSEWATHKFADCKAKRDTPTSCTVDYSTVYFVNIEVWVEAENALGKVTSDHINFDPVYKVKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDRPSKAPSFWYKIDPSHTQGYRTVQLVWKTLPPFEANGKILDYEVTLTRWKSHLQNYTVNATKLTVNLTNDRYLATLTVRNLVGKSDAAVLTIPACDFQATHPVMDLKAFPKDNMLWVEWTTPRESVKKYILEWCVLSDKAPCITDWQQEDGTVHRTYLRGNLAESKCYLITVTPVYADGPGSPESIKAYLKQAPPSKGPTVRTKKVGKNEAVLEWDQLPVDVQNGFIRNYTIFYRTIIGNETAVNVDSSHTEYTLSSLTSDTLYMVRMAAYTDEGGKDGPEFTFTTPKFAQGEIE

SEQ ID NO: 2560 - protein, 239 aa, synthetic construct
  REGION 1..239: note = IL7R (P16871) SP+PP+ECD
MTILGTTFGMVFSLLQVVSGESGYAQNGDLEDAELDDYSFSCYSQLEVNGSQHSLTCAFEDPDVNITNLEFEICGALVEVKCLNFRKLQEIYFIETKKFLLIGKSNICVKVGEKSLTCKKIDLTTIVKPEAPFDLSVVYREGANDFVVTFNTSHLQKKYVKVLMHDVAYRQEKDENKWTHVNLSSTKLTLLQRKLQPAAMYEIKVRSIPDHYFKGFWSEWSPSYYFRTPEINNSSGEMD

SEQ ID NO: 2561 - protein, 270 aa, synthetic construct; identical to SEQ ID NO: 900
  REGION 1..270: note = IL9R (Q01113) SP+PP+ECD

SEQ ID NO: 2562 - protein, 167 aa, synthetic construct
  REGION 1..167: note = ILDR1 (Q86SU0) SP+PP+ECD
MAWPKLPAPWLLLCTWLPAGCLSLLVTVQHTERYVTLFASIILKCDYTTSAQLQDVVVTWRFKSFCKDPIFDYYSASYQAALSLGQDPSNDCNDNQREVRIVAQRRGQNEPVLGVDYRQRKITIQNRADLVINEVMWWDHGVYYCTIEAPGDTSGDPDKEVKLIVLH

SEQ ID NO: 2563 - protein, 1099 aa, synthetic construct
  REGION 1..1099: note = IMPG2 (Q9BZV3) SP+PP+ECD
MIMFPLFGKISLGILIFVLIEGDFPSLTAQTYLSIEEIQEPKSAVSFLLPEESTDLSLATKKKQPLDRRETERQWLIRRRRSILFPNGVKICPDESVAEAVANHVKYFKVRVCQEAVWEAFRTFWDRLPGREEYHYWMNLCEDGVTSIFEMGTNFSESVEHRSLIMKKLTYAKETVSSSELSSPVPVGDTSTLGDTTLSVPHPEVDAYEGASESSLERPEESISNEIENVIEEATKPAGEQIAEFSIHLLGKQYREELQDSSSFHHQHLEEEFISEVENAFTGLPGYKEIRVLEFRSPKENDSGVDVYYAVTFNGEAISNTTWDLISLHSNKVENHGLVELDDKPTVVYTISNFRDYIAETLQQNFLLGNSSLNPDPDSLQLINVRGVLRHQTEDLVWNTQSSSLQATPSSILDNTFQAAWPSADESITSSIPPLDFSSGPPSATGRELWSESPLGDLVSTHKLAFPSKMGLSSSPEVLEVSSLTLHSVTPAVLQTGLPVASEERTSGSHLVEDGLANVEESEDFLSIDSLPSSSFTQPVPKETIPSMEDSDVSLTSSPYLTSSIPFGLDSLTSKVKDQLKVSPFLPDASMEKELIFDGGLGSGSGQKVDLITWPWSETSSEKSAEPLSKPWLEDDDSLLPAEIEDKKLVLVDKMDSTDQISKHSKYEHDDRSTHFPEEEPLSGPAVPIFADTAAESASLTLPKHISEVPGVDDYSVTKAPLILTSVAISASTDKSDQADAILREDMEQITESSNYEWFDSEVSMVKPDMQTLWTILPESERVWTRTSSLEKLSRDILASTPQSADRLWLSVTQSTKLPPTTISTLLEDEVIMGVQDISLELDRIGTDYYQPEQVQEQNGKVGSYVEMSTSVHSTEMVSVAWPTEGGDDLSYTQTSGALVVFFSLRVTNMMFSEDLFNKNSLEYKALEQRFLELLVPYLQSNLTGFQNLEILNFRNGSIVVNSRMKFANSVPPNVNNAVYMILEDFCTTAYNTMNLAIDKYSLDVESGDEANPCKFQACNEFSECLVNPWSGEAKCRCFPGYLSVEERPCQSLCDLQPDFCLNDGKCDIMPGHGAICRCRVGENWWYRGKHCEEFVSEP

SEQ ID NO: 2564 - protein, 956 aa, synthetic construct
  REGION 1..956: note = INSR (P06213) SP+PP+ECD
MATGGRRGAAAAPLLVAVAALLLGAAGHLYPGEVCPGMDIRNNLTRLHELENCSVIEGHLQILLMFKTRPEDFRDLSFPKLIMITDYLLLFRVYGLESLKDLFPNLTVIRGSRLFFNYALVIFEMVHLKELGLYNLMNITRGSVRIEKNNELCYLATIDWSRILDSVEDNYIVLNKDDNEECGDICPGTAKGKTNCPATVINGQFVERCWTHSHCQKVCPTICKSHGCTAEGLCCHSECLGNCSQPDDPTKCVACRNFYLDGRCVETCPPPYYHFQDWRCVNFSFCQDLHHKCKNSRRQGCHQYVIHNNKCIPECPSGYTMNSSNLLCTPCLGPCPKVCHLLEGEKTIDSVTSAQELRGCTVINGSLIINIRGGNNLAAELEANLGLIEEISGYLKIRRSYALVSLSFFRKLRLIRGETLEIGNYSFYALDNQNLRQLWDWSKHNLTITQGKLFFHYNPKLCLSEIHKMEEVSGTKGRQERNDIALKTNGDQASCENELLKFSYIRTSFDKILLRWEPYWPPDFRDLLGFMLFYKEAPYQNVTEFDGQDACGSNSWTVVDIDPPLRSNDPKSQNHPGWLMRGLKPWTQYAIFVKTLVTFSDERRTYGAKSDIIYVQTDATNPSVPLDPISVSNSSSQIILKWKPPSDPNGNITHYLVFWERQAEDSELFELDYCLKGLKLPSRTWSPPFESEDSQKHNQSEYEDSAGECCSCPKTDSQILKELEESSFRKTFEDYLHNVVFVPRKTSSGTGAEDPRPSRKRRSLGDVGNVTVAVPTVAAFPNTSSTSVPTSPEEHRPFEKVVNKESLVISGLRHFTGYRIELQACNQDTPEERCSVAAYVSARTMPEAKADDIVGPVTHEIFENNVVHLMWQEPKEPNGLIVLYEVSYRRYGDEELHLCVSRKHFALERGCRLRGLSPGNYSVRIRATSLAGNGSWTEPTYFYVTDYLDVPSNIAK

SEQ ID NO: 2565 - protein, 921 aa, synthetic construct
  REGION 1..921: note = INSRR (P14616) SP+PP+ECD
MAVPSLWPWGACLPVIFLSLGFGLDTVEVCPSLDIRSEVAELRQLENCSVVEGHLQILLMFTATGEDFRGLSFPRLTQVTDYLLLFRVYGLESLRDLFPNLAVIRGTRLFLGYALVIFEMPHLRDVALPALGAVLRGAVRVEKNQELCHLSTIDWGLLQPAPGANHIVGNKLGEECADVCPGVLGAAGEPCAKTTFSGHTDYRCWTSSHCQRVCPCPHGMACTARGECCHTECLGGCSQPEDPRACVACRHLYFQGACLWACPPGTYQYESWRCVTAERCASLHSVPGRASTFGIHQGSCLAQCPSGFTRNSSSIFCHKCEGLCPKECKVGTKTIDSIQAAQDLVGCTHVEGSLILNLRQGYNLEPQLQHSLGLVETITGFLKIKHSFALVSLGFFKNLKLIRGDAMVDGNYTLYVLDNQNLQQLGSWVAAGLTIPVGKIYFAFNPRLCLEHIYRLEEVTGTRGRQNKAEINPRTNGDRAACQTRTLRFVSNVTEADRILLRWERYEPLEARDLLSFIVYYKESPFQNATEHVGPDACGTQSWNLLDVELPLSRTQEPGVTLASLKPWTQYAVFVRAITLTTEEDSPHQGAQSPIVYLRTLPAAPTVPQDVISTSNSSSHLLVRWKPPTQRNGNLTYYLVLWQRLAEDGDLYLNDYCHRGLRLPTSNNDPRFDGEDGDPEAEMESDCCPCQHPPPGQVLPPLEAQEASFQKKFENFLHNAITIPISPWKVTSINKSPQRDSGRHRRAAGPLRLGGNSSDFEIQEDKVPRERAVLSGLRHFTEYRIDIHACNHAAHTVGCSAATFVFARTMPHREADGIPGKVAWEASSKNSVLLRWLEPPDPNGLILKYEIKYRRLGEEATVLCVSRLRYAKFGGVHLALLPPGNYSARVRATSLAGNGSWTDSVAFYILGPEEEDAGGLH

SEQ ID NO: 2566 - protein, 589 aa, synthetic construct
  REGION 1..589: note = ISLR2 (Q6UXK2) SP+PP+ECD
MFPLRALWLVWALLGVAGSCPEPCACVDKYAHQFADCAYKELREVPEGLPANVTTLSLSANKITVLRRGAFADVTQVTSLWLAHNEVRTVEPGALAVLSQLKNLDLSHNFISSFPWSDLRNLSALQLLKMNHNRLGSLPRDALGALPDLRSLRINNNRLRTLAPGTFDALSALSHLQLYHNPFHCGCGLVWLQAWAASTRVSLPEPDSIACASPPALQGVPVYRLPALPCAPPSVHLSAEPPLEAPGTPLRAGLAFVLHCIADGHPTPRLQWQLQIPGGTVVLEPPVLSGEDDGVGAEEGEGEGDGDLLTQTQAQTPTPAPAWPAPPATPRFLALANGSLLVPLLSAKEAGVYTCRAHNELGANSTSIRVAVAATGPPKHAPGAGGEPDGQAPTSERKSTAKGRGNSVLPSKPEGKIKGQGLAKVSILGETETEPEEDTSEGEEAEDQILADPAEEQRCGNGDPSRYVSNHAFNQSAELKPHVFELGVIALDVAEREARVQLTPLAARWGPGPGGAGGAPRPGRRPLRLLYLCPAGGGAAVQWSRVEEGVNAYWFRGLRPGTNYSVCLALAGEACHVQVVFSTKKELPS

SEQ ID NO: 2567 - protein, 566 aa, synthetic construct
  REGION 1..566: note = ITFG1 (Q8TB96) SP+PP+ECD
MAAAGRLPSSWALFSPLLAGLALLGVGPVPARALHNVTAELFGAEAWGTLAAFGDLNSDKQTDLFVLRERNDLIVFLADQNAPYFKPKVKVSFKNHSALITSVVPGDYDGDSQMDVLLTYLPKNYAKSELGAVIFWGQNQTLDPNNMTILNRTFQDEPLIMDFNGDLIPDIFGITNESNQPQILLGGNLSWHPALTTTSKMRIPHSHAFIDLTEDFTADLFLTTLNATTSTFQFEIWENLDGNFSVSTILEKPQNMMVVGQSAFADFDGDGHMDHLLPGCEDKNCQKSTIYLVRSGMKQWVPVLQDFSNKGTLWGFVPFVDEQQPTEIPIPITLHIGDYNMDGYPDALVILKNTSGSNQQAFLLENVPCNNASCEEARRMFKVYWELTDLNQIKDAMVATFFDIYEDGILDIVVLSKGYTKNDFAIHTLKNNFEADAYFVKVIVLSGLCSNDCPRKITPFGVNQPGPYIMYTTVDANGYLKNGSAGQLSQSAHLALQLPYNVLGLGRSANFLDHLYVGIPRPSGEKSIRKQEWTAIIPNSQLIVIPYPHNVPRSWSAKLYLTPSNI

SEQ ID NO: 2568 - protein, 1141 aa, synthetic construct
  REGION 1..1141: note = ITGA1 (P56199) SP+PP+ECD
MAPRPRARPGVAVACCWLLTVVLRCCVSFNVDVKNSMTFSGPVEDMFGYTVQQYENEEGKWVLIGSPLVGQPKNRTGDVYKCPVGRGESLPCVKLDLPVNTSIPNVTEVKENMTFGSTLVTNPNGGFLACGPLYAYRCGHLHYTTGICSDVSPTFQVVNSIAPVQECSTQLDIVIVLDGSNSIYPWDSVTAFLNDLLERMDIGPKQTQVGIVQYGENVTHEFNLNKYSSTEEVLVAAKKIVQRGGRQTMTALGIDTARKEAFTEARGARRGVKKVMVIVTDGESHDNHRLKKVIQDCEDENIQRFSIAILGSYNRGNLSTEKFVEEIKSIASEPTEKHFFNVSDELALVTIVKTLGERIFALEATADQSAASFEMEMSQTGFSAHYSQDWVMLGAVGAYDWNGTVVMQKASQIIIPRNTTFNVESTKKNEPLASYLGYTVNSATASSGDVLYIAGQPRYNHTGQVIIYRMEDGNIKILQTLSGEQIGSYFGSILTTTDIDKDSNTDILLVGAPMYMGTEKEEQGKVYVYALNQTRFEYQMSLEPIKQTCCSSRQHNSCTTENKNEPCGARFGTAIAAVKDLNLDGFNDIVIGAPLEDDHGGAVYIYHGSGKTIRKEYAQRIPSGGDGKTLKFFGQSIHGEMDLNGDGLTDVTIGGLGGAALFWSRDVAVVKVTMNFEPNKVNIQKKNCHMEGKETVCINATVCFDVKLKSKEDTIYEADLQYRVTLDSLRQISRSFFSGTQERKVQRNITVRKSECTKHSFYMLDKHDFQDSVRITLDFNLTDPENGPVLDDSLPNSVHEYIPFAKDCGNKEKCISDLSLHVATTEKDLLIVRSQNDKFNVSLTVKNTKDSAYNTRTIVHYSPNLVFSGIEAIQKDSCESNHNITCKVGYPFLRRGEMVTFKILFQFNTSYLMENVTIYLSATSDSEEPPETLSDNVVNISIPVKYEVGLQFYSSASEYHISIAANETVPEVINSTEDIGNEINIFYLIRKSGSFPMPELKLSISFPNMTSNGYPVLYPTGLSSSENANCRPHIFEDPFSINSGKKMTTSTDHLKRGTILDCNTCKFATITCNLTSSDISQVNVSLILWKPTFIKSYFSSLNLTIRGELRSENASLVLSSSNQKRELAIQISKDGLPGRVP

SEQ ID NO: 2569 - protein, 1122 aa, synthetic construct
  REGION 1..1122: note = ITGA10 (O75578) SP+PP+ECD
MELPFVTHLFLPLVFLTGLCSPFNLDEHHPRLFPGPPEAEFGYSVLQHVGGGQRWMLVGAPWDGPSGDRRGDVYRCPVGGAHNAPCAKGHLGDYQLGNSSHPAVNMHLGMSLLETDGDGGFMACAPLWSRACGSSVFSSGICARVDASFQPQGSLAPTAQRCPTYMDVVIVLDGSNSIYPWSEVQTFLRRLVGKLFIDPEQIQVGLVQYGESPVHEWSLGDFRTKEEVVRAAKNLSRREGRETKTAQAIMVACTEGFSQSHGGRPEAARLLVVVTDGESHDGEELPAALKACEAGRVTRYGIAVLGHYLRRQRDPSSFLREIRTIASDPDERFFFNVTDEAALTDIVDALGDRIFGLEGSHAENESSFGLEMSQIGFSTHRLKDGILFGMVGAYDWGGSVLWLEGGHRLFPPRMALEDEFPPALQNHAAYLGYSVSSMLLRGGRRLFLSGAPRFRHRGKVIAFQLKKDGAVRVAQSLQGEQIGSYFGSELCPLDTDRDGTTDVLLVAAPMFLGPQNKETGRVYVYLVGQQSLLTLQGTLQPEPPQDARFGFAMGALPDLNQDGFADVAVGAPLEDGHQGALYLYHGTQSGVRPHPAQRIAAASMPHALSYFGRSVDGRLDLDGDDLVDVAVGAQGAAILLSSRPIVHLTPSLEVTPQAISVVQRDCRRRGQEAVCLTAALCFQVTSRTPGRWDHQFYMRFTASLDEWTAGARAAFDGSGQRLSPRRLRLSVGNVTCEQLHFHVLDTSDYLRPVALTVTFALDNTTKPGPVLNEGSPTSIQKLVPFSKDCGPDNECVTDLVLQVNMDIRGSRKAPFVVRGGRRKVLVSTTLENRKENAYNTSLSLIFSRNLHLASLTPQRESPIKVECAAPSAHARLCSVGHPVFQTGAKVTFLLEFEFSCSSLLSQVFVKLTASSDSLERNGTLQDNTAQTSAYIQYEPHLLFSSESTLHRYEVHPYGTLPVGPGPEFKTTLRVQNLGCYVVSGLIISALLPAVAHGGNYFLSLSQVITNNASCIVQNLTEPPGPPVHPEELQHTNRLNGSNTQCQVVRCHLGQLAKGTEVSVGLLRLVHNEFFRRAKFKSLTVVSTFELGTEEGSVLQLTEASRWSESLLEVVQTRPILIS

SEQ ID NO: 2570 - protein, 1141 aa, synthetic construct
  REGION 1..1141: note = ITGA11 (Q9UKX5) SP+PP+ECD
MDLPRGLVVAWALSLWPGFTDTFNMDTRKPRVIPGSRTAFFGYTVQQHDISGNKWLVVGAPLETNGYQKTGDVYKCPVIHGNCTKLNLGRVTLSNVSERKDNMRLGLSLATNPKDNSFLACSPLWSHECGSSYYTTGMCSRVNSNFRFSKTVAPALQRCQTYMDIVIVLDGSNSIYPWVEVQHFLINILKKFYIGPGQIQVGVVQYGEDVVHEFHLNDYRSVKDVVEAASHIEQRGGTETRTAFGIEFARSEAFQKGGRKGAKKVMIVITDGESHDSPDLEKVIQQSERDNVTRYAVAVLGYYNRRGINPETFLNEIKYIASDPDDKHFFNVTDEAALKDIVDALGDRIFSLEGTNKNETSFGLEMSQTGFSSHVVEDGVLLGAVGAYDWNGAVLKETSAGKVIPLRESYLKEFPEELKNHGAYLGYTVTSVVSSRQGRVYVAGAPRFNHTGKVILFTMHNNRSLTIHQAMRGQQIGSYFGSEITSVDIDGDGVTDVLLVGAPMYFNEGRERGKVYVYELRQNLFVYNGTLKDSHSYQNARFGSSIASVRDLNQDSYNDVVVGAPLEDNHAGAIYIFHGFRGSILKTPKQRITASELATGLQYFGCSIHGQLDLNEDGLIDLAVGALGNAVILWSRPVVQINASLHFEPSKINIFHRDCKRSGRDATCLAAFLCFTPIFLAPHFQTTTVGIRYNATMDERRYTPRAHLDEGGDRFTNRAVLLSSGQELCERINFHVLDTADYVKPVTFSVEYSLEDPDHGPMLDDGWPTTLRVSVPFWNGCNEDEHCVPDLVLDARSDLPTAMEYCQRVLRKPAQDCSAYTLSFDTTVFIIESTRQRVAVEATLENRGENAYSTVLNISQSANLQFASLIQKEDSDGSIECVNEERRLQKQVCNVSYPFFRAKAKVAFRLDFEFSKSIFLHHLEIELAAGSDSNERDSTKEDNVAPLRFHLKYEADVLFTRSSSLSHYEVKPNSSLERYDGIGPPFSCIFRIQNLGLFPIHGMMMKITIPIATRSGNRLLKLRDFLTDEANTSCNIWGNSTEYRPTPVEEDLRRAPQLNHSNSDVVSINCNIRLVPNQEINFHLLGNLWLRSLKALKYKSMKIMVNAALQRQFHSPFIFREEDPSRQIVFEISKQEDWQVP

SEQ ID NO: 2571 - protein, 1132 aa, synthetic construct
  REGION 1..1132: note = ITGA2 (P17301) SP+PP+ECD
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKKGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWSQSIADVAIEASFTPEKITLVNKNAQIILKLCFSAKFRPTKQNNQVAIVYNITLDADGFSSRVTSRGLFKENNERCLQKNMVVNQAQSCPEHIIYIQEPSDVVNSLDLRVDISLENPGTSPALEAYSETAKVFSIPFHKDCGEDGLCISDLVLDVRQIPAAQEQPFIVSNQNKRLTFSVTLKNKRESAYNTGIVVDFSENLFFASFSLPVDGTEVTCQVAASQKSVACDVGYPALKREQQVTFTINFDFNLQNLQNQASLSFQALSESQEENKADNLVNLKIPLLYDAEIHLTRSTNINFYEISSDGNVPSIVHSFEDVGPKFIFSLKVTTGSVPVSMATVIIHIPQYTKEKNPLMYLTGVQTDKAGDISCNADINPLKIGQTSSSVSFKSENFRHTKELNCRTASCSNVTCWLKDVHMKGEYFVNVTTRIWNGTFASSTFQTVQLTAAAEINTYNPEIYVIEDNTVTIPLMIMKPDEKAEVPT

SEQ ID NO: 2572 - protein, 993 aa, synthetic construct
  REGION 1..993: note = ITGA2B (P08514) SP+PP+ECD
MARALCPLQALWLLEWVLLLLGPCAAPPAWALNLDPVQLTFYAGPNGSQFGFSLDFHKDSHGRVAIVVGAPRTLGPSQEETGGVFLCPWRAEGGQCPSLLFDLRDETRNVGSQTLQTFKARQGLGASVVSWSDVIVACAPWQHWNVLEKTEEAEKTPVGSCFLAQPESGRRAEYSPCRGNTLSRIYVENDFSWDKRYCEAGFSSVVTQAGELVLGAPGGYYFLGLLAQAPVADIFSSYRPGILLWHVSSQSLSFDSSNPEYFDGYWGYSVAVGEFDGDLNTTEYVVGAPTWSWTLGAVEILDSYYQRLHRLRGEQMASYFGHSVAVTDVNGDGRHDLLVGAPLYMESRADRKLAEVGRVYLFLQPRGPHALGAPSLLLTGTQLYGRFGSAIAPLGDLDRDGYNDIAVAAPYGGPSGRGQVLVFLGQSEGLRSRPSQVLDSPFPTGSAFGFSLRGAVDIDDNGYPDLIVGAYGANQVAVYRAQPVVKASVQLLVQDSLNPAVKSCVLPQTKTPVSCFNIQMCVGATGHNIPQKLSLNAELQLDRQKPRQGRRVLLLGSQQAGTTLNLDLGGKHSPICHTTMAFLRDEADFRDKLSPIVLSLNVSLPPTEAGMAPAVVLHGDTHVQEQTRIVLDCGEDDVCVPQLQLTASVTGSPLLVGADNVLELQMDAANEGEGAYEAELAVHLPQGAHYMRALSNVEGFERLICNQKKENETRVVLCELGNPMKKNAQIGIAMLVSVGNLEEAGESVSFQLQIRSKNSQNPNSKIVLLDVPVRAEAQVELRGNSFPASLVVAAEEGEREQNSLDSWGPKVEHTYELHNNGPGTVNGLHLSIHLPGQSQPSDLLYILDIQPQGGLQCFPQPPVNPLKVDWGLPIPSPSPIHPAHHKRDRRQIFLPEPEQPSRLQDPVLVSCDSAPCTVVQCDLQEMARGQRAMVTVLAFLWLPSLYQRPLDQFVLQSHAWFNVSSLPYAVPPLSLPRGEAQVWTQLLRALEER

SEQ ID NO: 2573 - protein, 991 aa, synthetic construct
  REGION 1..991: note = ITGA3 (P26006) SP+PP+ECD
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIE

SEQ ID NO: 2574 - protein, 976 aa, synthetic construct
  REGION 1..976: note = ITGA4 (P13612) SP+PP+ECD
MAWEARREPGPRRAAVRETVMLLLCLGVPTGRPNVDTESALLYQGPHNTLFGYSVVLHSHGANRWLLVGAPTANWLANASVINPGAIYRCRIGKNPGQTCEQLQLGSPNGEPCGKTCLEERDNQWLGVTLSRQPGENGSIVTCGHRWKNIFYIKNENKLPTGGCYGVPPDLRTELSKRIAPCYQDYVKKFGENFASCQAGISSFYTKDLIVMGAPGSSYWTGSLFVYNITTNKYKAFLDKQNQVKFGSYLGYSVGAGHFRSQHTTEVVGGAPQHEQIGKAYIFSIDEKELNILHEMKGKKLGSYFGASVCAVDLNADGFSDLLVGAPMQSTIREEGRVFVYINSGSGAVMNAMETNLVGSDKYAARFGESIVNLGDIDNDGFEDVAIGAPQEDDLQGAIYIYNGRADGISSTFSQRIEGLQISKSLSMFGQSISGQIDADNNGYVDVAVGAFRSDSAVLLRTRPVVIVDASLSHPESVNRTKFDCVENGWPSVCIDLTLCFSYKGKEVPGYIVLFYNMSLDVNRKAESPPRFYFSSNGTSDVITGSIQVSSREANCRTHQAFMRKDVRDILTPIQIEAAYHLGPHVISKRSTEEFPPLQPILQQKKEKDIMKKTINFARFCAHENCSADLQVSAKIGFLKPHENKTYLAVGSMKTLMLNVSLFNAGDDAYETTLHVKLPVGLYFIKILELEEKQINCEVTDNSGVVQLDCSIGYIYVDHLSRIDISFLLDVSSLSRAEEDLSITVHATCENEEEMDNLKHSRVTVAIPLKYEVKLTVHGFVNPTSFVYGSNDENEPETCMVEKMNLTFHVINTGNSMAPNVSVEIMVPNSFSPQTDKLFNILDVQTTTGECHFENYQRVCALEQQKSAMQTLKGIVRFLSKTDKRLLYCIKADPHCLNFLCNFGKMESGKEASVHIQLEGRPSILEMDETSALKFEIRATGFPEPNPRVIELNKDENVAHVLLEGLHHQRPKRYFT

SEQ ID NO: 2575 - protein, 995 aa, synthetic construct
  REGION 1..995: note = ITGA5 (P08648) SP+PP+ECD
MGSRTPESPLHAVQLRWGPRRRPPLLPLLLLLLPPPPRVGGFNLDAEAPAVLSGPPGSFFGFSVEFYRPGTDGVSVLVGAPKANTSQPGVLQGGAVYLCPWGASPTQCTPIEFDSKGSRLLESSLSSSEGEEPVEYKSLQWFGATVRAHGSSILACAPLYSWRTEKEPLSDPVGTCYLSTDNFTRILEYAPCRSDFSWAAGQGYCQGGFSAEFTKTGRVVLGGPGSYFWQGQILSATQEQIAESYYPEYLINLVQGQLQTRQASSIYDDSYLGYSVAVGEFSGDDTEDFVAGVPKGNLTYGYVTILNGSDIRSLYNFSGEQMASYFGYAVAATDVNGDGLDDLLVGAPLLMDRTPDGRPQEVGRVYVYLQHPAGIEPTPTLTLTGHDEFGRFGSSLTPLGDLDQDGYNDVAIGAPFGGETQQGVVFVFPGGPGGLGSKPSQVLQPLWAASHTPDFFGSALRGGRDLDGNGYPDLIVGSFGVDKAVVYRGRPIVSASASLTIFPAMFNPEERSCSLEGNPVACINLSFCLNASGKHVADSIGFTVELQLDWQKQKGGVRRALFLASRQATLTQTLLIQNGAREDCREMKIYLRNESEFRDKLSPIHIALNFSLDPQAPVDSHGLRPALHYQSKSRIEDKAQILLDCGEDNICVPDLQLEVFGEQNHVYLGDKNALNLTFHAQNVGEGGAYEAELRVTAPPEAEYSGLVRHPGNFSSLSCDYFAVNQSRLLVCDLGNPMKAGASLWGGLRFTVPHLRDTKKTIQFDFQILSKNLNNSQSDVVSFRLSVEAQAQVTLNGVSKPEAVLFPVSDWHPRDQPQKEEDLGPAVHHVYELINQGPSSISQGVLELSCPQALEGQQLLYVTRVTGLNCTTNHPINPKGLELDPEGSLHHQQKREAPSRSSASSGPQILKCPEAECFRLRCELGPLHQQESQSLQLHFRVWAKTFLQREHQPFSLQCEAVYKALKMPYRILPRQLPQKERQVATAVQWTKAEGSY

SEQ ID NO: 2576 - protein, 1050 aa, synthetic construct
  REGION 1..1050: note = ITGA6 (P23229) SP+PP+ECD
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGLLFLTSVSYTDPDQFVYKTRPPREQPDTFPDVMMNSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYS

SEQ ID NO: 2577 - protein, 1082 aa, synthetic construct
  REGION 1..1082: note = ITGA7 (Q13683) SP+PP+ECD
MAGARSRDPWGASGICYLFGSLLVELLFSRAVAFNLDVMGALRKEGEPGSLFGFSVALHRQLQPRPQSWLLVGAPQALALPGQQANRTGGLFACPLSLEETDCYRVDIDQGADMQKESKENQWLGVSVRSQGPGGKIVTCAHRYEARQRVDQILETRDMIGRCFVLSQDLAIRDELDGGEWKFCEGRPQGHEQFGFCQQGTAAAFSPDSHYLLFGAPGTYNWKGTARVELCAQGSADLAHLDDGPYEAGGEKEQDPRLIPVPANSYFGLLFVTNIDSSDPDQLVYKTLDPADRLPGPAGDLALNSYLGFSIDSGKGLVRAEELSFVAGAPRANHKGAVVILRKDSASRLVPEVMLSGERLTSGFGYSLAVADLNSDGWPDLIVGAPYFFERQEELGGAVYVYLNQGGHWAGISPLRLCGSPDSMFGISLAVLGDLNQDGFPDIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVALDYVLDADTDRRLRGQVPRVTFLSRNLEEPKHQASGTVWLKHQHDRVCGDAMFQLQENVKDKLRAIVVTLSYSLQTPRLRRQAPGQGLPPVAPILNAHQPSTQRAEIHFLKQGCGEDKICQSNLQLVRARFCTRVSDTEFQPLPMDVDGTTALFALSGQPVIGLELMVTNLPSDPAQPQADGDDAHEAQLLVMLPDSLHYSGVRALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITLDCARGTANCVVFSCPLYSFDRAAVLHVWGRLWNSTFLEEYSAVKSLEVIVRANITVKSSIKNLMLRDASTVIPVMVYLDPMAVVAEGVPW

SEQ ID NO: 2578 - protein, 1012 aa, synthetic construct
  REGION 1..1012: note = ITGA8 (P53708) SP+PP+ECD
MSPGASRGPRGSQAPLIAPLCCAAAALGMLLWSPACQAFNLDVEKLTVYSGPKGSYFGYAVDFHIPDARTASVLVGAPKANTSQPDIVEGGAVYYCPWPAEGSAQCRQIPFDTTNNRKIRVNGTKEPIEFKSNQWFGATVKAHKGKVVACAPLYHWRTLKPTPEKDPVGTCYVAIQNFSAYAEFSPCRNSNADPEGQGYCQAGFSLDFYKNGDLIVGGPGSFYWQGQVITASVADIIANYSFKDILRKLAGEKQTEVAPASYDDSYLGYSVAAGEFTGDSQQELVAGIPRGAQNFGYVSIINSTDMTFIQNFTGEQMASYFGYTVVVSDVNSDGLDDVLVGAPLFMEREFESNPREVGQIYLYLQVSSLLFRDPQILTGTETFGRFGSAMAHLGDLNQDGYNDIAIGVPFAGKDQRGKVLIYNGNKDGLNTKPSQVLQGVWASHAVPSGFGFTLRGDSDIDKNDYPDLIVGAFGTGKVAVYRARPVVTVDAQLLLHPMIINLENKTCQVPDSMTSAACFSLRVCASVTGQSIANTIVLMAEVQLDSLKQKGAIKRTLFLDNHQAHRVFPLVIKRQKSHQCQDFIVYLRDETEFRDKLSPINISLNYSLDESTFKEGLEVKPILNYYRENIVSEQAHILVDCGEDNLCVPDLKLSARPDKHQVIIGDENHLMLIINARNEGEGAYEAELFVMIPEEADYVGIERNNKGFRPLSCEYKMENVTRMVVCDLGNPMVSGTNYSLGLRFAVPRLEKTNMSINFDLQIRSSNKDNPDSNFVSLQINITAVAQVEIRGVSHPPQIVLPIHNWEPEEEPHKEEEVGPLVEHIYELHNIGPSTISDTILEVGWPFSARDEFLLYIFHIQTLGPLQCQPNPNINPQDIKPAASPEDTPELSAFLRNSTIPHLVRKRDVHVVEFHRQSPAKILNCTNIECLQISCAVGRLEGGESAVLKVRSRLWAHTFLQRKNDPYALASLVSFEVKKMPYTDQPAKLPEGSIVIKTSVIWATPNVSFSIPL

SEQ ID NO: 2579 - protein, 981 aa, synthetic construct
  REGION 1..981: note = ITGA9 (Q13797) SP+PP+ECD
MGGPAAPRGAGRLRALLLALVVAGIPAGAYNLDPQRPVHFQGPADSFFGYAVLEHFHDNTRWVLVGAPKADSKYSPSVKSPGAVFKCRVHTNPDRRCTELDMARGKNRGTSCGKTCREDRDDEWMGVSLARQPKADGRVLACAHRWKNIYYEADHILPHGFCYIIPSNLQAKGRTLIPCYEEYKKKYGEEHGSCQAGIAGFFTEELVVMGAPGSFYWAGTIKVLNLTDNTYLKLNDEVIMNRRYTYLGYAVTAGHFSHPSTIDVVGGAPQDKGIGKVYIFRADRRSGTLIKIFQASGKKMGSYFGSSLCAVDLNGDGLSDLLVGAPMFSEIRDEGQVTVYINRGNGALEEQLALTGDGAYNAHFGESIASLDDLDNDGFPDVAIGAPKEDDFAGAVYIYHGDAGGIVPQYSMKLSGQKINPVLRMFGQSISGGIDMDGNGYPDVTVGAFMSDSVVLLRARPVITVDVSIFLPGSINITAPQCHDGQQPVNCLNVTTCFSFHGKHVPGEIGLNYVLMADVAKKEKGQMPRVYFVLLGETMGQVTEKLQLTYMEETCRHYVAHVKRRVQDVISPIVFEAAYSLSEHVTGEEERELPPLTPVLRWKKGQKIAQKNQTVFERNCRSEDCAADLQLQGKLLLSSMDEKTLYLALGAVKNISLNISISNLGDDAYDANVSFNVSRELFFINMWQKEEMGISCELLESDFLKCSVGFPFMRSKSKYEFSVIFDTSHLSGEEEVLSFIVTAQSGNTERSESLHDNTLVLMVPLMHEVDTSITGIMSPTSFVYGESVDAANFIQLDDLECHFQPINITLQVYNTGPSTLPGSSVSISFPNRLSSGGAEMFHVQEMVVGQEKGNCSFQKNPTPCIIPQEQENIFHTIFAFFTKSGRKVLDCEKPGISCLTAHCNFSALAKEESRTIDIYMLLNTEILKKDSSSVIQFMSRAKVKVDPALRVVEIAHGNPEEVTVVFEALHNLEPRGYVVGW

SEQ ID NO: 2580 - protein, 1099 aa, synthetic construct
  REGION 1..1099: note = ITGAD (Q13349) SP+PP+ECD
MTFGTVLLLSVLASYHGFNLDVEEPTIFQEDAGGFGQSVVQFGGSRLVVGAPLEVVAANQTGRLYDCAAATGMCQPIPLHIRPEAVNMSLGLTLAASTNGSRLLACGPTLHRVCGENSYSKGSCLLLGSRWEIIQTVPDATPECPHQEMDIVFLIDGSGSIDQNDFNQMKGFVQAVMGQFEGTDTLFALMQYSNLLKIHFTFTQFRTSPSQQSLVDPIVQLKGLTFTATGILTVVTQLFHHKNGARKSAKKILIVITDGQKYKDPLEYSDVIPQAEKAGIIRYAIGVGHAFQGPTARQELNTISSAPPQDHVFKVDNFAALGSIQKQLQEKIYAVEGTQSRASSSFQHEMSQEGFSTALTMDGLFLGAVGSFSWSGGAFLYPPNMSPTFINMSQENVDMRDSYLGYSTELALWKGVQNLVLGAPRYQHTGKAVIFTQVSRQWRKKAEVTGTQIGSYFGASLCSVDVDSDGSTDLILIGAPHYYEQTRGGQVSVCPLPRGRVQWQCDAVLRGEQGHPWGRFGAALTVLGDVNEDKLIDVAIGAPGEQENRGAVYLFHGASESGISPSHSQRIASSQLSPRLQYFGQALSGGQDLTQDGLMDLAVGARGQVLLLRSLPVLKVGVAMRFSPVEVAKAVYRCWEEKPSALEAGDATVCLTIQKSSLDQLGDIQSSVRFDLALDPGRLTSRAIFNETKNPTLTRRKTLGLGIHCETLKLLLPDCVEDVVSPIILHLNFSLVREPIPSPQNLRPVLAVGSQDLFTASLPFEKNCGQDGLCEGDLGVTLSFSGLQTLTVGSSLELNVIVTVWNAGEDSYGTVVSLYYPAGLSHRRVSGAQKQPHQSALRLACETVPTEDEGLRSSRCSVNHPIFHEGSNGTFIVTFDVSYKATLGDRMLMRASASSENNKASSSKATFQLELPVKYAVYTMISRQEESTKYFNFATSDEKKMKEAEHRYRVNNLSQRDLAISINFWVPVLLNGVAVWDVVMEAPSQSLPCVSERKPPQHSDFLTQISRSPMLDCSIADCLQFRCDVPSFSVQEELDFTLKGNLSFGWVRETLQKKVLVVSVAEITFDTSVYSQLPGQEAFMRAQMEMVLEEDEVYN

SEQ ID NO: 2581 - protein, 1124 aa, synthetic construct
  REGION 1..1124: note = ITGAE (P38570) SP+PP+ECD
MWLFHTLLCIASLALLAAFNVDVARPWLTPKGGAPFVLSSLLHQDPSTNQTWLLVTSPRTKRTPGPLHRCSLVQDEILCHPVEHVPIPKGRHRGVTVVRSHHGVLICIQVLVRRPHSLSSELTGTCSLLGPDLRPQAQANFFDLENLLDPDARVDTGDCYSNKEGGGEDDVNTARQRRALEKEEEEDKEEEEDEEEEEAGTEIAIILDGSGSIDPPDFQRAKDFISNMMRNFYEKCFECNFALVQYGGVIQTEFDLRDSQDVMASLARVQNITQVGSVTKTASAMQHVLDSIFTSSHGSRRKASKVMVVLTDGGIFEDPLNLTTVINSPKMQGVERFAIGVGEEFKSARTARELNLIASDPDETHAFKVTNYMALDGLLSKLRYNIISMEGTVGDALHYQLAQIGFSAQILDERQVLLGAVGAFDWSGGALLYDTRSRRGRFLNQTAAAAADAEAAQYSYLGYAVAVLHKTCSLSYIAGAPRYKHHGAVFELQKEGREASFLPVLEGEQMGSYFGSELCPVDIDMDGSTDFLLVAAPFYHVHGEEGRVYVYRLSEQDGSFSLARILSGHPGFTNARFGFAMAAMGDLSQDKLTDVAIGAPLEGFGADDGASFGSVYIYNGHWDGLSASPSQRIRASTVAPGLQYFGMSMAGGFDISGDGLADITVGTLGQAVVFRSRPVVRLKVSMAFTPSALPIGFNGVVNVRLCFEISSVTTASESGLREALLNFTLDVDVGKQRRRLQCSDVRSCLGCLREWSSGSQLCEDLLLMPTEGELCEEDCFSNASVKVSYQLQTPEGQTDHPQPILDRYTEPFAIFQLPYEKACKNKLFCVAELQLATTVSQQELVVGLTKELTLNINLTNSGEDSYMTSMALNYPRNLQLKRMQKPPSPNIQCDDPQPVASVLIMNCRIGHPVLKRSSAHVSVVWQLEENAFPNRTADITVTVTNSNERRSLANETHTLQFRHGFVAVLSKPSIMYVNTGQGLSHHKEFLFHVHGENLFGAEYQLQICVPTKLRGLQVVAVKKLTRTQASTVCTWSQERACAYSSVQHVEEWHSVSCVIASDKENVTVAAEISWDHSEELLKDVTELQILGEISFNKSLYEGLNAENHRTKITVVFLKDEKYHS

SEQ ID NO: 2582 - protein, 1090 aa, synthetic construct
  REGION 1..1090: note = ITGAL (P20701) SP+PP+ECD
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILACDPGLSRTCDQNTYLSGLCYLFRQNLQGPMLQGRPGFQECIKGNVDLVFLFDGSMSLQPDEFQKILDFMKDVMKKLSNTSYQFAAVQFSTSYKTEFDFSDYVKRKDPDALLKHVKHMLLLTNTFGAINYVATEVFREELGARPDATKVLIIITDGEATDSGNIDAAKDIIRYIIGIGKHFQTKESQETLHKFASKPASEFVKILDTFEKLKDLFTELQKKIYVIEGTSKQDLTSFNMELSSSGISADLSRGHAVVGAVGAKDWAGGFLDLKADLQDDTFIGNEPLTPEVRAGYLGYTVTWLPSRQKTSLLASGAPRYQHMGRVLLFQEPQGGGHWSQVQTIHGTQIGSYFGGELCGVDVDQDGETELLLIGAPLFYGEQRGGRVFIYQRRQLGFEEVSELQGDPGYPLGRFGEAITALTDINGDGLVDVAVGAPLEEQGAVYIFNGRHGGLSPQPSQRIEGTQVLSGIQWFGRSIHGVKDLEGDGLADVAVGAESQMIVLSSRPVVDMVTLMSFSPAEIPVHEVECSYSTSNKMKEGVNITICFQIKSLIPQFQGRLVANLTYTLQLDGHRTRRRGLFPGGRHELRRNIAVTTSMSCTDFSFHFPVCVQDLISPINVSLNFSLWEEEGTPRDQRAQGKDIPPILRPSLHSETWEIPFEKNCGEDKKCEANLRVSFSPARSRALRLTAFASLSVELSLSNLEEDAYWVQLDLHFPPGLSFRKVEMLKPHSQIPVSCEELPEESRLLSRALSCNVSSPIFKAGHSVALQMMFNTLVNSSWGDSVELHANVTCNNEDSDLLEDNSATTIIPILYPINILIQDQEDSTLYVSFTPKGPKIHQVKHMYQVRIQPSIHDHNIPTLEAVVGVPQPPSEGPITHQWSVQMEPPVPCHYEDLERLPDAAEPCLPGALFRCPVVFRQEILVQVIGTLELVGEIEASSMFSLCSSLSISFNSSKHFHLYGSNASLAQVVMKVDVVYEKQML

SEQ ID NO: 2583 - protein, 1104 aa, synthetic construct
  REGION 1..1104: note = ITGAM (P11215) SP+PP+ECD
MALRVLLLTALTLCHGFNLDTENAMTFQENARGFGQSVVQLQGSRVVVGAPQEIVAANQRGSLYQCDYSTGSCEPIRLQVPVEAVNMSLGLSLAATTSPPQLLACGPTVHQTCSENTYVKGLCFLFGSNLRQQPQKFPEALRGCPQEDSDIAFLIDGSGSIIPHDFRRMKEFVSTVMEQLKKSKTLFSLMQYSEEFRIHFTFKEFQNNPNPRSLVKPITQLLGRTHTATGIRKVVRELFNITNGARKNAFKILVVITDGEKFGDPLGYEDVIPEADREGVIRYVIGVGDAFRSEKSRQELNTIASKPPRDHVFQVNNFEALKTIQNQLREKIFAIEGTQTGSSSSFEHEMSQEGFSAAITSNGPLLSTVGSYDWAGGVFLYTSKEKSTFINMTRVDSDMNDAYLGYAAAIILRNRVQSLVLGAPRYQHIGLVAMFRQNTGMWESNANVKGTQIGAYFGASLCSVDVDSNGSTDLVLIGAPHYYEQTRGGQVSVCPLPRGRARWQCDAVLYGEQGQPWGRFGAALTVLGDVNGDKLTDVAIGAPGEEDNRGAVYLFHGTSGSGISPSHSQRIAGSKLSPRLQYFGQSLSGGQDLTMDGLVDLTVGAQGHVLLLRSQPVLRVKAIMEFNPREVARNVFECNDQVVKGKEAGEVRVCLHVQKSTRDRLREGQIQSVVTYDLALDSGRPHSRAVFNETKNSTRRQTQVLGLTQTCETLKLQLPNCIEDPVSPIVLRLNFSLVGTPLSAFGNLRPVLAEDAQRLFTALFPFEKNCGNDNICQDDLSITFSFMSLDCLVVGGPREFNVTVTVRNDGEDSYRTQVTFFFPLDLSYRKVSTLQNQRSQRSWRLACESASSTEVSGALKSTSCSINHPIFPENSEVTFNITFDVDSKASLGNKLLLKANVTSENNMPRTNKTEFQLELPVKYAVYMVVTSHGVSTKYLNFTASENTSRVMQHQYQVSNLGQRSLPISLVFLVPVRLNQTVIWDRPQVTFSENLSSTCHTKERLPSHSDFLAELRKAPVVNCSIAVCQRIQCDIPFFGIQEEFNATLKGNLSFDWYIKTSHNHLLIVSTAEILFNDSVFTLLPGQGAFVRSQTETKVEPFEVPN

SEQ ID NO: 2584 - protein, 992 aa, synthetic construct
  REGION 1..992: note = ITGAV (P06756) SP+PP+ECD
MAFPPRRRLRLGPRGLPLLLSGLLLPLCRAFNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSMPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLKQKGAIRRALFLYSRSPSHSKNMTISRGGLMQCEELIAYLRDESEFRDKLTPITIFMEYRLDYRTAADTTGLQPILNQFTPANISRQAHILLDCGEDNVCKPKLEVSVDSDQKKIYIGDDNPLTLIVKAQNQGEGAYEAELIVSIPLQADFIGVVRNNEALARLSCAFKTENQTRQVVCDLGNPMKAGTQLLAGLRFSVHQQSEMDTSVKFDLQIQSSNLFDKVSPVVSHKVDLAVLAAVEIRGVSSPDHVFLPIPNWEHKENPETEEDVGPVVQHIYELRNNGPSSFSKAMLHLQWPYKYNNNTLLYILHYDIDGPMNCTSDMEINPLRIKISSLQTTEKNDTVAGQGERDHLITKRDLALSEGDIHTLGCGVAQCLKIVCQVGRLDRGKSAILYVKSLLWTETFMNKENQNHSYSLKSSASFNVIEFPYKNLPIEDITNSTLVTTNVTWGIQPAPMPV

SEQ ID NO: 2585 - protein, 1107 aa, synthetic construct
  REGION 1..1107: note = ITGAX (P20702) SP+PP+ECD
MTRTRAALLLFTALATSLGFNLDTEELTAFRVDSAGFGDSVVQYANSWVVVGAPQKITAANQTGGLYQCGYSTGACEPIGLQVPPEAVNMSLGLSLASTTSPSQLLACGPTVHHECGRNMYLTGLCFLLGPTQLTQRLPVSRQECPRQEQDIVFLIDGSGSISSRNFATMMNFVRAVISQFQRPSTQFSLMQFSNKFQTHFTFEEFRRSSNPLSLLASVHQLQGFTYTATAIQNVVHRLFHASYGARRDAAKILIVITDGKKEGDSLDYKDVIPMADAAGIIRYAIGVGLAFQNRNSWKELNDIASKPSQEHIFKVEDFDALKDIQNQLKEKIFAIEGTETTSSSSFELEMAQEGFSAVFTPDGPVLGAVGSFTWSGGAFLYPPNMSPTFINMSQENVDMRDSYLGYSTELALWKGVQSLVLGAPRYQHTGKAVIFTQVSRQWRMKAEVTGTQIGSYFGASLCSVDVDSDGSTDLVLIGAPHYYEQTRGGQVSVCPLPRGWRRWWCDAVLYGEQGHPWGRFGAALTVLGDVNGDKLTDVVIGAPGEEENRGAVYLFHGVLGPSISPSHSQRIAGSQLSSRLQYFGQALSGGQDLTQDGLVDLAVGARGQVLLLRTRPVLWVGVSMQFIPAEIPRSAFECREQVVSEQTLVQSNICLYIDKRSKNLLGSRDLQSSVTLDLALDPGRLSPRATFQETKNRSLSRVRVLGLKAHCENFNLLLPSCVEDSVTPITLRLNFTLVGKPLLAFRNLRPMLAADAQRYFTASLPFEKNCGADHICQDNLGISFSFPGLKSLLVGSNLELNAEVMVWNDGEDSYGTTITFSHPAGLSYRYVAEGQKQGQLRSLHLTCDSAPVGSQGTWSTSCRINHLIFRGGAQITFLATFDVSPKAVLGDRLLLTANVSSENNTPRTSKTTFQLELPVKYAVYTVVSSHEQFTKYLNFSESEEKESHVAMHRYQVNNLGQRDLPVSINFWVPVELNQEAVWMDVEVSHPQNPSLRCSSEKIAPPASDFLAHIQKNPVLDCSIAGCLRFRCDVPSFSVQEELDFTLKGNLSFGWVRQILQKKVSVVSVAEITFDTSVYSQLPGQEAFMRAQTTTVLEKYKVHNPTP

SEQ ID NO: 2586 - protein, 728 aa, synthetic construct
  REGION 1..728: note = ITGB1 (P05556) SP+PP+ECD
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPD

SEQ ID NO: 2587 - protein, 700 aa, synthetic construct
  REGION 1..700: note = ITGB2 (P05107) SP+PP+ECD
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEITESGRIGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYEKLTEIIPKSAVGELSEDSSNVVQLIKNAYNKLSSRVFLDHNALPDTLKVTYDSFCSNGVTHRNQPRGDCDGVQINVPITFQVKVTATECIQEQSFVIRALGFTDIVTVQVLPQCECRCRDQSRDRSLCHGKGFLECGICRCDTGYIGKNCECQTQGRSSQELEGSCRKDNNSIICSGLGDCVCGQCLCHTSDVPGKLIYGQYCECDTINCERYNGQVCGGPGRGLCFCGKCRCHPGFEGSACQCERTTEGCLNPRRVECSGRGRCRCNVCECHSGYQLPLCQECPGCPSPCGKYISCAECLKFEKGPFGKNCSAACPGLQLSNNPVKGRTCKERDSEGCWVAYTLEQQDGMDRYLIYVDESRECVAGPN

SEQ ID NO: 2588 - protein, 718 aa, synthetic construct
  REGION 1..718: note = ITGB3 (P05106) SP+PP+ECD
MRARPRPRPLWATVLALGALAGVGVGGPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPD

SEQ ID NO: 2589 - protein, 710 aa, synthetic construct
  REGION 1..710: note = ITGB4 (P16144) SP+PP+ECD
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGS

SEQ ID NO: 2590 - protein, 719 aa, synthetic construct
  REGION 1..719: note = ITGB5 (P18084) SP+PP+ECD
MPRAPAPLYACLLGLCALLPRLAGLNICTSGSATSCEECLLIHPKCAWCSKEDFGSPRSITSRCDLRANLVKNGCGGEIESPASSFHVLRSLPLSSKGSGSAGWDVIQMTPQEIAVNLRPGDKTTFQLQVRQVEDYPVDLYYLMDLSLSMKDDLDNIRSLGTKLAEEMRKLTSNFRLGFGSFVDKDISPFSYTAPRYQTNPCIGYKLFPNCVPSFGFRHLLPLTDRVDSFNEEVRKQRVSRNRDAPEGGFDAVLQAAVCKEKIGWRKDALHLLVFTTDDVPHIALDGKLGGLVQPHDGQCHLNEANEYTASNQMDYPSLALLGEKLAENNINLIFAVTKNHYMLYKNFTALIPGTTVEILDGDSKNIIQLIINAYNSIRSKVELSVWDQPEDLNLFFTATCQDGVSYPGQRKCEGLKIGDTASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCRGRDGQICSERGHCLCGQCQCTEPGAFGEMCEKCPTCPDACSTKRDCVECLLLHSGKPDNQTCHSLCRDEVITWVDTIVKDDQEAVLCFYKTAKDCVMMFTYVELPSGKSNLTVLREPECGNTPN

SEQ ID NO: 2591 - protein, 709 aa, synthetic construct
  REGION 1..709: note = ITGB6 (P18564) SP+PP+ECD
MGIELLCLFFLFLGRNDHVQGGCALGGAETCEDCLLIGPQCAWCAQENFTHPSGVGERCDTPANLLAKGCQLNFIENPVSQVEILKNKPLSVGRQKNSSDIVQIAPQSLILKLRPGGAQTLQVHVRQTEDYPVDLYYLMDLSASMDDDLNTIKELGSRLSKEMSKLTSNFRLGFGSFVEKPVSPFVKTTPEEIANPCSSIPYFCLPTFGFKHILPLTNDAERFNEIVKNQKISANIDTPEGGFDAIMQAAVCKEKIGWRNDSLHLLVFVSDADSHFGMDSKLAGIVIPNDGLCHLDSKNEYSMSTVLEYPTIGQLIDKLVQNNVLLIFAVTQEQVHLYENYAKLIPGATVGLLQKDSGNILQLIISAYEELRSEVELEVLGDTEGLNLSFTAICNNGTLFQHQKKCSHMKVGDTASFSVTVNIPHCERRSRHIIIKPVGLGDALELLVSPECNCDCQKEVEVNSSKCHHGNGSFQCGVCACHPGHMGPRCECGEDMLSTDSCKEAPDHPSCSGRGDCYCGQCICHLSPYGNIYGPYCQCDNFSCVRHKGLLCGGNGDCDCGECVCRSGWTGEYCNCTTSTDSCVSEDGVLCSGRGDCVCGKCVCTNPGASGPTCERCPTCGDPCNSKRSCIECHLSAAGQAREECVDKCKLAGATISEEEDFSKDGSVSCSLQGENECLITFLITTDNEGKTIIHSINEKDCPKPPNIP

SEQ ID NO: 2592 - protein, 723 aa, synthetic construct
  REGION 1..723: note = ITGB7 (P26010) SP+PP+ECD
MVALPMVLVLLLVLSRGESELDAKIPSTGDATEWRNPHLSMLGSCQPAPSCQKCILSHPSCAWCKQLNFTASGEAEARRCARREELLARGCPLEELEEPRGQQEVLQDQPLSQGARGEGATQLAPQRVRVTLRPGEPQQLQVRFLRAEGYPVDLYYLMDLSYSMKDDLERVRQLGHALLVRLQEVTHSVRIGFGSFVDKTVLPFVSTVPSKLRHPCPTRLERCQSPFSFHHVLSLTGDAQAFEREVGRQSVSGNLDSPEGGFDAILQAALCQEQIGWRNVSRLLVFTSDDTFHTAGDGKLGGIFMPSDGHCHLDSNGLYSRSTEFDYPSVGQVAQALSAANIQPIFAVTSAALPVYQELSKLIPKSAVGELSEDSSNVVQLIMDAYNSLSSTVTLEHSSLPPGVHISYESQCEGPEKREGKAEDRGQCNHVRINQTVTFWVSLQATHCLPEPHLLRLRALGFSEELIVELHTLCDCNCSDTQPQAPHCSDGQGHLQCGVCSCAPGRLGRLCECSVAELSSPDLESGCRAPNGTGPLCSGKGHCQCGRCSCSGQSSGHLCECDDASCERHEGILCGGFGRCQCGVCHCHANRTGRACECSGDMDSCISPEGGLCSGHGRCKCNRCQCLDGYYGALCDQCPGCKTPCERHRDCAECGAFRTGPLATNCSTACAHTNVTLALAPILDDGWCKERTLDNQLFFFLVEDDARGTVVLRVRPQEKGADH

SEQ ID NO: 2593 - protein, 684 aa, synthetic construct
  REGION 1..684: note = ITGB8 (P26012) SP+PP+ECD
MCGSALAFFTAAFVCLQNDRRGPASFLWAAWVFSLVLGLGQGEDNRCASSNAASCARCLALGPECGWCVQEDFISGGSRSERCDIVSNLISKGCSVDSIEYPSVHVIIPTENEINTQVTPGEVSIQLRPGAEANFMLKVHPLKKYPVDLYYLVDVSASMHNNIEKLNSVGNDLSRKMAFFSRDFRLGFGSYVDKTVSPYISIHPERIHNQCSDYNLDCMPPHGYIHVLSLTENITEFEKAVHRQKISGNIDTPEGGFDAMLQAAVCESHIGWRKEAKRLLLVMTDQTSHLALDSKLAGIVVPNDGNCHLKNNVYVKSTTMEHPSLGQLSEKLIDNNINVIFAVQGKQFHWYKDLLPLLPGTIAGEIESKAANLNNLVVEAYQKLISEVKVQVENQVQGIYFNITAICPDGSRKPGMEGCRNVTSNDEVLFNVTVTMKKCDVTGGKNYAIIKPIGFNETAKIHIHRNCSCQCEDNRGPKGKCVDETFLDSKCFQCDENKCHFDEDQFSSESCKSHKDQPVCSGRGVCVCGKCSCHKIKLGKVYGKYCEKDDFSCPYHHGNLCAGHGECEAGRCQCFSGWEGDRCQCPSAAAQHCVNSKGQVCSGRGTCVCGRCECTDPRSIGRFCEHCPTCYTACKENWNCMQCLHPHNLSQAILDQCKTSCALMEQQHYVDQTSECFSSPSYLR

SEQ ID NO: 2594 - protein, 292 aa, synthetic construct
  REGION 1..292: note = IZUMO1 (Q8IYV9) SP+PP+ECD
MGPHFTLLCAALAGCLLPAEGCVICDPSVVLALKSLEKDYLPGHLDAKHHKAMMERVENAVKDFQELSLNEDAYMGVVDEATLQKGSWSLLKDLKRITDSDVKGDLFVKELFWMLHLQKETFATYVARFQKEAYCPNKCGVMLQTLIWCKNCKKEVHACRKSYDCGERNVEVPQMEDMILDCELNWHQASEGLTDYSFYRVWGNNTETLVSKGKEATLTKPMVGPEDAGSYRCELGSVNSSPATIINFHVTVLPKMIKEEKPSPNIVTPGEATTESSISLQPLQPEKMLASR

SEQ ID NO: 2595 - protein, 174 aa, synthetic construct
  REGION 1..174: note = IZUMO3 (Q5VZ72) SP+PP+ECD
MGDLWLFLLLPLSAFHGVKGCLECDPKFIEDVGSLLGNLIPSEVPGRTQLLERQIKEMIHLSFKVSHSDKRLRVLAVQQVVKLRTWLKNEFYKLGNETWKGVFIYQGKLLDVCQNLESKLKELLKNFSEIACSEDCIVVEGPILDCWTCLRMTNRCFKGEYCGDEDPRKAENRE

SEQ ID NO: 2596 - protein, 1067 aa, synthetic construct
  REGION 1..1067: note = JAG1 (P78504) SP+PP+ECD
MRSPRTRGRSGRPLSLLLALLCALRAKVCGASGQFELEILSMQNVNGELQNGNCCGGARNPGDRKCTRDECDTYFKVCLKEYQSRVTAGGPCSFGSGSTPVIGGNTFNLKASRGNDRNRIVLPFSFAWPRSYTLLVEAWDSSNDTVQPDSIIEKASHSGMINPSRQWQTLKQNTGVAHFEYQIRVTCDDYYYGFGCNKFCRPRDDFFGHYACDQNGNKTCMEGWMGPECNRAICRQGCSPKHGSCKLPGDCRCQYGWQGLYCDKCIPHPGCVHGICNEPWQCLCETNWGGQLCDKDLNYCGTHQPCLNGGTCSNTGPDKYQCSCPEGYSGPNCEIAEHACLSDPCHNRGSCKETSLGFECECSPGWTGPTCSTNIDDCSPNNCSHGGTCQDLVNGFKCVCPPQWTGKTCQLDANECEAKPCVNAKSCKNLIASYYCDCLPGWMGQNCDININDCLGQCQNDASCRDLVNGYRCICPPGYAGDHCERDIDECASNPCLNGGHCQNEINRFQCLCPTGFSGNLCQLDIDYCEPNPCQNGAQCYNRASDYFCKCPEDYEGKNCSHLKDHCRTTPCEVIDSCTVAMASNDTPEGVRYISSNVCGPHGKCKSQSGGKFTCDCNKGFTGTYCHENINDCESNPCRNGGTCIDGVNSYKCICSDGWEGAYCETNINDCSQNPCHNGGTCRDLVNDFYCDCKNGWKGKTCHSRDSQCDEATCNNGGTCYDEGDAFKCMCPGGWEGTTCNIARNSSCLPNPCHNGGTCVVNGESFTCVCKEGWEGPICAQNTNDCSPHPCYNSGTCVDGDNWYRCECAPGFAGPDCRININECQSSPCAFGATCVDEINGYRCVCPPGHSGAKCQEVSGRPCITMGSVIPDGAKWDDDCNTCQCLNGRIACSKVWCGPRPCLLHKGHSECPSGQSCIPILDDQCFVHPCTGVGECRSSSLQPVKTKCTSDSYYQDNCANITFTFNKEMMSPGLTTEHICSELRNLNILKNVSAEYSIYIACEPSPSANNEIHVAISAEDIRDDGNPIKEITDKIIDLVSKRDGNSSLIAAVAEVRVQRRPLKNRTD

SEQ ID NO: 2597 - protein, 1080 aa, synthetic construct
  REGION 1..1080: note = JAG2 (Q9Y219) SP+PP+ECD
MRAQGRGRLPRRLLLLLALWVQAARPMGYFELQLSALRNVNGELLSGACCDGDGRTTRAGGCGHDECDTYVRVCLKEYQAKVTPTGPCSYGHGATPVLGGNSFYLPPAGAAGDRARARARAGGDQDPGLVVIPFQFAWPRSFTLIVEAWDWDNDTTPNEELLIERVSHAGMINPEDRWKSLHFSGHVAHLELQIRVRCDENYYSATCNKFCRPRNDFFGHYTCDQYGNKACMDGWMGKECKEAVCKQGCNLLHGGCTVPGECRCSYGWQGRFCDECVPYPGCVHGSCVEPWQCNCETNWGGLLCDKDLNYCGSHHPCTNGGTCINAEPDQYRCTCPDGYSGRNCEKAEHACTSNPCANGGSCHEVPSGFECHCPSGWSGPTCALDIDECASNPCAAGGTCVDQVDGFECICPEQWVGATCQLDANECEGKPCLNAFSCKNLIGGYYCDCIPGWKGINCHINVNDCRGQCQHGGTCKDLVNGYQCVCPRGFGGRHCELERDECASSPCHSGGLCEDLADGFHCHCPQGFSGPLCEVDVDLCEPSPCRNGARCYNLEGDYYCACPDDFGGKNCSVPREPCPGGACRVIDGCGSDAGPGMPGTAASGVCGPHGRCVSQPGGNFSCICDSGFTGTYCHENIDDCLGQPCRNGGTCIDEVDAFRCFCPSGWEGELCDTNPNDCLPDPCHSRGRCYDLVNDFYCACDDGWKGKTCHSREFQCDAYTCSNGGTCYDSGDTFRCACPPGWKGSTCAVAKNSSCLPNPCVNGGTCVGSGASFSCICRDGWEGRTCTHNTNDCNPLPCYNGGICVDGVNWFRCECAPGFAGPDCRINIDECQSSPCAYGATCVDEINGYRCSCPPGRAGPRCQEVIGFGRSCWSRGTPFPHGSSWVEDCNSCRCLDGRRDCSKVWCGWKPCLLAGQPEALSAQCPLGQRCLEKAPGQCLRPPCEAWGECGAEEPPSTPCLPRSGHLDNNCARLTLHFNRDHVPQGTTVGAICSGIRSLPATRAVARDRLLVLLCDRASSGASAVEVAVSFSPARDLPDSSLIQGAAHAIVAAITQRGNSSLLLAVTEVKVETVVTGGSST

SEQ ID NO: 2598 - protein, 238 aa, synthetic construct
  REGION 1..238: note = JAM2 (P57087) SP+PP+ECD
MARRSRHRLLLLLLRYLVVALGYHKAYGFSAPKDQQVVTAVEYQEAILACKTPKKTVSSRLEWKKLGRSVSFVYYQQTLQGDFKNRAEMIDFNIRIKNVTRSDAGKYRCEVSAPSEQGQNLEEDTVTLEVLVAPAVPSCEVPSSALSGTVVELRCQDKEGNPAPEYTWFKDGIRLLENPRLGSQSTNSSYTMNTKTGTLQFNTVSKLDTGEYSCEARNSVGYRRCPGKRMQVDDLNIS

SEQ ID NO: 2599 - protein, 241 aa, synthetic construct
  REGION 1..241: note = JAM3 (Q9BX67) SP+PP+ECD
MALRRPPRLRLCARLPDFFLLLLFRGCLIGAVNLKSSNRTPVVQEFESVELSCIITDSQTSDPRIEWKKIQDEQTTYVFFDNKIQGDLAGRAEILGKTSLKIWNVTRRDSALYRCEVVARNDRKEIDEIVIELTVQVKPVTPVCRVPKAVPVGKMATLHCQESEGHPRPHYSWYRNDVPLPTDSRANPRFRNSSFHLNSETGTLVFTAVHKDDSGQYYCIASNDAGSARCEEQEMEVYDLN

SEQ ID NO: 2600 - protein, 196 aa, synthetic construct
  REGION 1..196: note = KCT2 (Q8NC54) SP+PP+ECD
MAAAVPKRMRGPAQAKLLPGSAIQALVGLARPLVLALLLVSAALSSVVSRTDSPSPTVLNSHISTPNVNALTHENQTKPSISQISTTLPPTTSTKKSGGASVVPHPSPTPLSQEEADNNEDPSIEEEDLLMLNSSPSTAKDTLDNGDYGEPDYDWTTGPRDDDESDDTLEENRGYMEIEQSVKSFKMPSSNIEEED

SEQ ID NO: 2601 - protein, 764 aa, synthetic construct
  REGION 1..764: note = KDR (P35968) SP+PP+ECD
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLE

SEQ ID NO: 2602 - protein, 120 aa, synthetic construct
  REGION 1..120: note = KIAA0247 (Q92537) SP+PP+ECD
MCHGRIAPKSTSVFAVASVGHGVFLPLVILCTLLGDGLASVCPLPPEPENGGYICHPRPCRDPLTAGSVIEYLCAEGYMLKGDYKYLTCKNGEWKPAMEISCRLNEDKDTHTSLGVPTLS

SEQ ID NO: 2603 - protein, 955 aa, synthetic construct
  REGION 1..955: note = KIAA0319 (Q5VV43) SP+PP+ECD
MAPPTGVLSSLLLLVTIAGCARKQCSEGRTYSNAVISPNLETTRIMRVSHTFPVVDCTAACCDLSSCDLAWWFEGRCYLVSCPHKENCEPKKMGPIRSYLTFVLRPVQRPAQLLDYGDMMLNRGSPSGIWGDSPEDIRKDLTFLGKDWGLEEMSEYSDDYRELEKDLLQPSGKQEPRGSAEYTDWGLLPGSEGAFNSSVGDSPAVPAETQQDPELHYLNESASTPAPKLPERSVLLPLPTTPSSGEVLEKEKASQLQEQSSNSSGKEVLMPSHSLPPASLELSSVTVEKSPVLTVTPGSTEHSIPTPPTSAAPSESTPSELPISPTTAPRTVKELTVSAGDNLIITLPDNEVELKAFVAPAPPVETTYNYEWNLISHPTDYQGEIKQGHKQTLNLSQLSVGLYVFKVTVSSENAFGEGFVNVTVKPARRVNLPPVAVVSPQLQELTLPLTSALIDGSQSTDDTEIVSYHWEEINGPFIEEKTSVDSPVLRLSNLDPGNYSFRLTVTDSDGATNSTTAALIVNNAVDYPPVANAGPNHTITLPQNSITLNGNQSSDDHQIVLYEWSLGPGSEGKHVVMQGVQTPYLHLSAMQEGDYTFQLKVTDSSRQQSTAVVTVIVQPENNRPPVAVAGPDKELIFPVESATLDGSSSSDDHGIVFYHWEHVRGPSAVEMENIDKAIATVTGLQVGTYHFRLTVKDQQGLSSTSTLTVAVKKENNSPPRARAGGRHVLVLPNNSITLDGSRSTDDQRIVSYLWIRDGQSPAAGDVIDGSDHSVALQLTNLVEGVYTFHLRVTDSQGASDTDTATVEVQPDPRKSGLVELTLQVGVGQLTEQRKDTLVRQLAVLLNVLDSDIKVQKIRAHSDLSTVIVFYVQSRPPFKVLKAAEVARNLHMRLSKEKADFLLFKVLRVDTAGCLLKCSGHGHCDPLTKRCICSHLWMENLIQRYIWDGESNCEWS

SEQ ID NO: 2604 - protein, 869 aa, synthetic construct
  REGION 1..869: note = KIAA0922 (A2VDJ0) SP+PP+ECD
MAGLRRPQPGCYCRTAAAVNLLLGVFQVLLPCCRPGGAQGQAIEPLPNVVELWQAEEGELLLPTQGDSEEGLEEPSQEQSFSDKLFSGKGLHFQPSVLDFGIQFLGHPVAKILHAYNPSRDSEVVVNSVFAAAGHFHVPPVPCRVIPAMGKTSFRIIFLPTEEGSIESSLFINTSSYGVLSYHVSGIGTRRISTEGSAKQLPNAYFLLPKVQSIQLSQMQAETTNTSLLQVQLECSLHNKVCQQLKGCYLESDDVLRLQMSIMVTMENFSKEFEENTQHLLDHLSIVYVATDESETSDDSAVNMYILHSGNSLIWIQDIRHFSQRDALSLQFEPVLLPTSTTNFTKIASFTCKATSCDSGIIEDVKKTTHTPTLKACLFSSVAQGYFRMDSSATQFHIETHENTSGLWSIWYRNHFDRSVVLNDVFLSKETKHMLKILNFTGPLFLPPGCWNIFSLKLAVKDIAINLFTNVFLTTNIGAIFAIPLQIYSAPTKEGSLGFEVIAHCGMHYFMGKSKAGNPNWNGSLSLDQSTWNVDSELANKLYERWKKYKNGDVCKRNVLGTTRFAHLKKSKESESFVFFLPRLIAEPGLMLNFSATALRSRMIKYFVVQNPSSWPVSLQLLPLSLYPKPEALVHLLHRWFGTDMQMINFTTGEFQLTEACPYLGTHSEESRFGILHLHLQPLEMKRVGVVFTPADYGKVTSLILIRNNLTVIDMIGVEGFGARELLKVGGRLPGAGGSLRFKVPESTLMDCRRQLKDSKQILSITKNFKVENIGPLPITVSSLKINGYNCQGYGFEVLDCHQFSLDPNTSRDISIVFTPDFTSSWVIRDLSLVTAADLEFRFTLNVTLPHHLLPLCADVVPGPSWEES

SEQ ID NO: 2605 - protein, 910 aa, synthetic construct
  REGION 1..910: note = KIAA1324 (Q6UXG2) SP+PP+ECD
MAEPGHSHHLSARVRGRTERRIPRLWRLLLWAGTAFQVTQGTGPELHACKESEYHYEYTACDSTGSRWRVAVPHTPGLCTSLPDPIKGTECSFSCNAGEFLDMKDQSCKPCAEGRYSLGTGIRFDEWDELPHGFASLSANMELDDSAAESTGNCTSSKWVPRGDYIASNTDECTATLMYAVNLKQSGTVNFEYYYPDSSIIFEFFVQNDQCQPNADDSRWMKTTEKGWEFHSVELNRGNNVLYWRTTAFSVWTKVPKPVLVRNIAITGVAYTSECFPCKPGTYADKQGSSFCKLCPANSYSNKGETSCHQCDPDKYSEKGSSSCNVRPACTDKDYFYTHTACDANGETQLMYKWAKPKICSEDLEGAVKLPASGVKTHCPPCNPGFFKTNNSTCQPCPYGSYSNGSDCTRCPAGTEPAVGFEYKWWNTLPTNMETTVLSGINFEYKGMTGWEVAGDHIYTAAGASDNDFMILTLVVPGFRPPQSVMADTENKEVARITFVFETLCSVNCELYFMVGVNSRTNTPVETWKGSKGKQSYTYIIEENTTTSFTWAFQRTTFHEASRKYTNDVAKIYSINVTNVMNGVASYCRPCALEASDVGSSCTSCPAGYYIDRDSGTCHSCPTNTILKAHQPYGVQACVPCGPGTKNNKIHSLCYNDCTFSRNTPTRTFNYNFSALANTVTLAGGPSFTSKGLKYFHHFTLSLCGNQGRKMSVCTDNVTDLRIPEGESGFSKSITAYVCQAVIIPPEVTGYKAGVSSQPVSLADRLIGVTTDMTLDGITSPAELFHLESLGIPDVIFFYRSNDVTQSCSSGRSTTIRVRCSPQKTVPGSLLLPGTCSDGTCDGCNFHFLWESAAACPLCSVADYHAIVSSCVAGIQKTTYVWREPKLCSGGISLPEQRVTICKTIDFWLK

SEQ ID NO: 2606 - protein, 929 aa, synthetic construct
  REGION 1..929: note = KIAA1324L (A8MWY0) SP+PP+ECD
MLFRARGPVRGRGWGRPAEAPRRGRSPPWSPAWICCWALAGCQAAWAGDLPSSSSRPLPPCQEKDYHFEYTECDSSGSRWRVAIPNSAVDCSGLPDPVRGKECTFSCASGEYLEMKNQVCSKCGEGTYSLGSGIKFDEWDELPAGFSNIATFMDTVVGPSDSRPDGCNNSSWIPRGNYIESNRDDCTVSLIYAVHLKKSGYVFFEYQYVDNNIFFEFFIQNDQCQEMDTTTDKWVKLTDNGEWGSHSVMLKSGTNILYWRTTGILMGSKAVKPVLVKNITIEGVAYTSECFPCKPGTFSNKPGSFNCQVCPRNTYSEKGAKECIRCKDDSQFSEEGSSECTERPPCTTKDYFQIHTPCDEEGKTQIMYKWIEPKICREDLTDAIRLPPSGEKKDCPPCNPGFYNNGSSSCHPCPPGTFSDGTKECRPCPAGTEPALGFEYKWWNVLPGNMKTSCFNVGNSKCDGMNGWEVAGDHIQSGAGGSDNDYLILNLHIPGFKPPTSMTGATGSELGRITFVFETLCSADCVLYFMVDINRKSTNVVESWGGTKEKQAYTHIIFKNATFTFTWAFQRTNQGQDNRRFINDMVKIYSITATNAVDGVASSCRACALGSEQSGSSCVPCPPGHYIEKETNQCKECPPDTYLSIHQVYGKEACIPCGPGSKNNQDHSVCYSDCFFYHEKENQSLHYDFSNLSSVGSLMNGPSFTSKGTKYFHFFNISLCGHEGKKMALCTNNITDFTVKEIVAGSDDYTNLVGAFVCQSTIIPSESKGFRAALSSQSIILADTFIGVTVETTLKNINIKEDMFPVPTSQIPDVHFFYKSSTATTSCINGRSTAVKMRCNPTKSGAGVISVPSKCPAGTCDGCTFYFLWESAEACPLCTEHDFHEIEGACKRGFQETLYVWNEPKWCIKGISLPEKKLATCETVDFWLK

SEQ ID NO: 2607 - protein, 97 aa, synthetic construct
  REGION 1..97: note = KIAA1644 (Q3SXP7) SP+PP+ECD
MTSCGQQSLNVLAVLFSLLFSAVLSAHFRVCEPYTDHKGRYHFGFHCPRLSDNKTFILCCHHNNTVFKYCCNETEFQAVMQANLTASSEGYMHNNYT

SEQ ID NO: 2608 - protein, 245 aa, synthetic construct
  REGION 1..245: note = KIR2DL1 (P43626) SP+PP+ECD
MSLLVVSMACVGFFLLQGAWPHEGVHRKPSLLAHPGPLVKSEETVILQCWSDVMFEHFLLHREGMFNDTLRLIGEHHDGVSKANFSISRMTQDLAGTYRCYGSVTHSPYQVSAPSDPLDIVIIGLYEKPSLSAQPGPTVLAGENVTLSCSSRSSYDMYHLSREGEAHERRLPAGPKVNGTFQADFPLGPATHGGTYRCFGSFHDSPYEWSKSSDPLLVSVTGNPSNSWPSPTEPSSKTGNPRHLH

SEQ ID NO: 2609 - protein, 245 aa, synthetic construct
  REGION 1..245: note = KIR2DL2 (P43627) SP+PP+ECD
MSLMVVSMACVGFFLLQGAWPHEGVHRKPSLLAHPGRLVKSEETVILQCWSDVRFEHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHECRFSAGPKVNGTFQADFPLGPATHGGTYRCFGSFRDSPYEWSNSSDPLLVSVIGNPSNSWPSPTEPSSKTGNPRHLH

SEQ ID NO: 2610 - protein, 245 aa, synthetic construct
  REGION 1..245: note = KIR2DL3 (P43628) SP+PP+ECD
MSLMVVSMVCVGFFLLQGAWPHEGVHRKPSLLAHPGPLVKSEETVILQCWSDVRFQHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSETGNPRHLH

SEQ ID NO: 2611 - protein, 242 aa, synthetic construct
  REGION 1..242: note = KIR2DL4 (Q99706) SP+PP+ECD
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTGIARHLH

SEQ ID NO: 2612 - protein, 238 aa, synthetic construct
  REGION 1..238: note = KIR2DL5A (Q8N109) SP+PP+ECD
MSLMVISMACVGFFLLQGAWTHEGGQDKPLLSAWPSAVVPRGGHVTLLCRSRLGFTIFSLYKEDGVPVPELYNKIFWKSILMGPVTPAHAGTYRCRGSHPRSPIEWSAPSNPLVIVVTGLFGKPSLSAQPGPTVRTGENVTLSCSSRSSFDMYHLSREGRAHEPRLPAVPSVNGTFQADFPLGPATHGGTYTCFGSLHDSPYEWSDPSDPLLVSVTGNSSSSSSSPTEPSSKTGIRRH

SEQ ID NO: 2613 - protein, 238 aa, synthetic construct
  REGION 1..238: note = KIR2DL5B (Q8NHK3) SP+PP+ECD
MSLMVVSMACVGFFLLQGAWTHEGGQDKPLLSAWPSAVVPRGGHVTLLCRSRLGFTIFSLYKEDGVPVPELYNKIFWKSILMGPVTPAHAGTYRCRGSHPRSPIEWSAPSNPLVIVVTGLFGKPSLSAQPGPTVRTGENVTLSCSSRSSFDMYHLSREGRAHEPRLPAVPSVDGTFQADFPLGPATHGGTYTCFSSLHDSPYEWSDPSDPLLVSVTGNSSSSSSSPTEPSSKTGIRRH

SEQ ID NO: 2614 - protein, 245 aa, synthetic construct
  REGION 1..245: note = KIR2DS1 (Q14954) SP+PP+ECD
MSLTVVSMACVGFFLLQGAWPHEGVHRKPSLLAHPGRLVKSEETVILQCWSDVMFEHFLLHREGMFNDTLRLIGEHHDGVSKANFSISRMKQDLAGTYRCYGSVTHSPYQLSAPSDPLDIVIIGLYEKPSLSAQPGPTVLAGENVTLSCSSRSSYDMYHLSREGEAHERRLPAGTKVNGTFQANFPLGPATHGGTYRCFGSFRDSPYEWSKSSDPLLVSVTGNPSNSWPSPTEPSSETGNPRHLH

SEQ ID NO: 2615 - protein, 245 aa, synthetic construct
  REGION 1..245: note = KIR2DS2 (P43631) SP+PP+ECD
MSLMVVSMACVGFFLLQGAWPHEGVHRKPSLLAHPGPLVKSEETVILQCWSDVRFEHFLLHREGKYKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSKTGNPRHLH

SEQ ID NO: 2616 - protein, 245 aa, synthetic construct
  REGION 1..245: note = KIR2DS3 (Q14952) SP+PP+ECD
MSLMVISMACVGFFWLQGAWPHEGFRRKPSLLAHPGRLVKSEETVILQCWSDVMFEHFLLHREGTFNDTLRLIGEHIDGVSKANFSIGRMRQDLAGTYRCYGSVPHSPYQFSAPSDPLDIVITGLYEKPSLSAQPGPTVLAGESVTLSCSSWSSYDMYHLSTEGEAHERRFSAGPKVNGTFQADFPLGPATQGGTYRCFGSFHDSPYEWSKSSDPLLVSVTGNPSNSWPSPTEPSSKTGNPRHLH

SEQ ID NO: 2617 - protein, 245 aa, synthetic construct
  REGION 1..245: note = KIR2DS4 (P43632) SP+PP+ECD
MSLMVIIMACVGFFLLQGAWPQEGVHRKPSFLALPGHLVKSEETVILQCWSDVMFEHFLLHREGKFNNTLHLIGEHHDGVSKANFSIGPMMPVLAGTYRCYGSVPHSPYQLSAPSDPLDMVIIGLYEKPSLSAQPGPTVQAGENVTLSCSSRSSYDMYHLSREGEAHERRLPAVRSINGTFQADFPLGPATHGGTYRCFGSFRDAPYEWSNSSDPLLVSVTGNPSNSWPSPTEPSSKTGNPRHLH

SEQ ID NO: 2618 - protein, 245 aa, synthetic construct
  REGION 1..245: note = KIR2DS5 (Q14953) SP+PP+ECD
MSLMVISMACVAFFLLQGAWPHEGFRRKPSLLAHPGPLVKSEETVILQCWSDVMFEHFLLHREGTFNHTLRLIGEHIDGVSKGNFSIGRMTQDLAGTYRCYGSVTHSPYQLSAPSDPLDIVITGLYEKPSLSAQPGPTVLAGESVTLSCSSRSSYDMYHLSREGEAHERRLPAGPKVNRTFQADFPLDPATHGGTYRCFGSFRDSPYEWSKSSDPLLVSVTGNSSNSWPSPTEPSSETGNPRHLH

SEQ ID NO: 2619 - protein, 340 aa, synthetic construct
  REGION 1..340: note = KIR3DL1 (P43629) SP+PP+ECD
MSLMVVSMACVGLFLVQRAGPHMGGQDKPFLSAWPSAVVPRGGHVTLRCHYRHRFNNFMLYKEDRIHIPIFHGRIFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNPRHLH

SEQ ID NO: 2620 - protein, 340 aa, synthetic construct
  REGION 1..340: note = KIR3DL2 (P43630) SP+PP+ECD
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSAPSNPLVIMVTGNHRKPSLLAHPGPLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGNPSSSWPSPTEPSSKSGICRHLH

SEQ ID NO: 2621 - protein, 322 aa, synthetic construct
  REGION 1..322: note = KIR3DL3 (Q8N743) SP+PP+ECD
MSLMVVSMACVGFFLLEGPWPHVGGQDKPFLSAWPGTVVSEGQHVTLQCRSRLGFNEFSLSKEDGMPVPELYNRIFRNSFLMGPVTPAHAGTYRCCSSHPHSPTGWSAPSNPVVIMVTGVHRKPSLLAHPGPLVKSGETVILQCWSDVRFERFLLHREGITEDPLRLVGQLHDAGSQVNYSMGPMTPALAGTYRCFGSVTHLPYELSAPSDPLDIVVVGLYGKPSLSAQPGPTVQAGENVTLSCSSRSLFDIYHLSREAEAGELRLTAVLRVNGTFQANFPLGPVTHGGNYRCFGSFRALPHAWSDPSDPLPVSVTGNSRHL

SEQ ID NO: 2622 - protein, 340 aa, synthetic construct
  REGION 1..340: note = KIR3DS1 (Q14943) SP+PP+ECD
MLLMVVSMACVGLFLVQRAGPHMGGQDKPFLSAWPSAVVPRGGHVTLRCHYRHRFNNFMLYKEDRIHVPIFHGRIFQEGFNMSPVTTAHAGNYTCRGSHPHSPTGWSAPSNPMVIMVTGNHRKPSLLAHPGPLVKSGERVILQCWSDIMFEHFFLHREWISKDPSRLVGQIHDGVSKANFSIGSMMRALAGTYRCYGSVTHTPYQLSAPSDPLDIVVTGLYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNLRHLH

SEQ ID NO: 2623 - protein, 499 aa, synthetic construct
  REGION 1..499: note = KIRREL (Q96J84) SP+PP+ECD
MLSLLVWILTLSDTFSQGTQTRFSQEPADQTVVAGQRAVLPCVLLNYSGIVQWTKDGLALGMGQGLKAWPRYRVVGSADAGQYNLEITDAELSDDASYECQATEAALRSRRAKLTVLIPPEDTRIDGGPVILLQAGTPHNLTCRAFNAKPAATIIWFRDGTQQEGAVASTELLKDGKRETTVSQLLINPTDLDIGRVFTCRSMNEAIPSGKETSIELDVHHPPTVTLSIEPQTVQEGERVVFTCQATANPEILGYRWAKGGFLIEDAHESRYETNVDYSFFTEPVSCEVHNKVGSTNVSTLVNVHFAPRIVVDPKPTTTDIGSDVTLTCVWVGNPPLTLTWTKKDSNMVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEEREVLPVGIIA

SEQ ID NO: 2624 - protein, 510 aa, synthetic construct
  REGION 1..510: note = KIRREL2 (Q6UWL6) SP+PP+ECD
MLRMRVPALLVLLFCFRGRAGPSPHFLQQPEDLVVLLGEEARLPCALGAYWGLVQWTKSGLALGGQRDLPGWSRYWISGNAANGQHDLHIRPVELEDEASYECQATQAGLRSRPAQLHVLVPPEAPQVLGGPSVSLVAGVPANLTCRSRGDARPTPELLWFRDGVLLDGATFHQTLLKEGTPGSVESTLTLTPFSHDDGATFVCRARSQALPTGRDTAITLSLQYPPEVTLSASPHTVQEGEKVIFLCQATAQPPVTGYRWAKGGSPVLGARGPRLEVVADASFLTEPVSCEVSNAVGSANRSTALDVLFGPILQAKPEPVSVDVGEDASFSCAWRGNPLPRVTWTRRGGAQVLGSGATLRLPSVGPEDAGDYVCRAEAGLSGLRGGAAEARLTVNAPPVVTALHSAPAFLRGPARLQCLVFASPAPDAVVWSWDEGFLEAGSQGRFLVETFPAPESRGGLGPGLISVLHISGTQESDFSRSFNCSARNRLGEGGAQASLGRRDLLPTVR

SEQ ID NO: 2625 - protein, 535 aa, synthetic construct
  REGION 1..535: note = KIRREL3 (Q8IZU9) SP+PP+ECD
MKPFQLDLLFVCFFLFSQELGLQKRGCCLVLGYMAKDKFRRMNEGQVYSFSQQPQDQVVVSGQPVTLLCAIPEYDGFVLWIKDGLALGVGRDLSSYPQYLVVGNHLSGEHHLKILRAELQDDAVYECQAIQAAIRSRPARLTVLVPPDDPVILGGPVISLRAGDPLNLTCHADNAKPAASIIWLRKGEVINGATYSKTLLRDGKRESIVSTLFISPGDVENGQSIVCRATNKAIPGGKETSVTIDIQHPPLVNLSVEPQPVLEDNVVTFHCSAKANPAVTQYRWAKRGQIIKEASGEVYRTTVDYTYFSEPVSCEVTNALGSTNLSRTVDVYFGPRMTTEPQSLLVDLGSDAIFSCAWTGNPSLTIVWMKRGSGVVLSNEKTLTLKSVRQEDAGKYVCRAVVPRVGAGEREVTLTVNGPPIISSTQTQHALHGEKGQIKCFIRSTPPPDRIAWSWKENVLESGTSGRYTVETISTEEGVISTLTISNIVRADFQTIYNCTAWNSFGSDTEIIRLKEQGSEMKSGAGLEAESVPMA

SEQ ID NO: 2626 - protein, 524 aa, synthetic construct
  REGION 1..524: note = KIT (P10721) SP+PP+ECD
MRGARGAWDFLCVLLLLLRVQTGSSQPSVSPGEPSPPSIHPGKSDLIVRVGDEIRLLCTDPGFVKWTFEILDETNENKQNEWITEKAEATNTGKYTCTNKHGLSNSIYVFVRDPAKLFLVDRSLYGKEDNDTLVRCPLTDPEVTNYSLKGCQGKPLPKDLRFIPDPKAGIMIKSVKRAYHRLCLHCSVDQEGKSVLSEKFILKVRPAFKAVPVVSVSKASYLLREGEEFTVTCTIKDVSSSVYSTWKRENSQTKLQEKYNSWHHGDFNYERQATLTISSARVNDSGVFMCYANNTFGSANVTTTLEVVDKGFINIFPMINTTVFVNDGENVDLIVEYEAFPKPEHQQWIYMNRTFTDKWEDYPKSENESNIRYVSELHLTRLKGTEGGTYTFLVSNSDVNAAIAFNVYVNTKPEILTYDRLVNGMLQCVAAGFPEPTIDWYFCPGTEQRCSASVLPVDVQTLNSSGPPFGKLVVQSSIDSSAFKHNGTVECKAYNDVGKTSAYFNFAFKGNNKEQIHPHTLFTP

SEQ ID NO: 2627 - protein, 214 aa, synthetic construct
  REGION 1..214: note = KITLG (P21583) SP+PP+ECD
MKKTQTWILTCIYLQLLLFNPLVKTEGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLH

SEQ ID NO: 2628 - protein, 981 aa, synthetic construct
  REGION 1..981: note = KL (Q9UEF7) SP+PP+ECD
MPASAPPRRPRPPPPSLSLLLVLLGLGGRRLRAEPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKS

SEQ ID NO: 2629 - protein, 391 aa, synthetic construct
  REGION 1..391: note = KREMEN1 (Q96MU8) SP+PP+ECD
MAPPAARLALLSAAALTLARPAPSPGLGPECFTANGADYRGTQNWTALQGGKPCLFWNETFQHPYNTLKYPNGEGGLGEHNYCRNPDGDVSPWCYVAEHEDGVYWKYCEIPACQMPGNLGCYKDHGNPPPLTGTSKTSNKLTIQTCISFCRSQRFKFAGMESGYACFCGNNPDYWKYGEAASTECNSVCFGDHTQPCGGDGRIILFDTLVGACGGNYSAMSSVVYSPDFPDTYATGRVCYWTIRVPGASHIHFSFPLFDIRDSADMVELLDGYTHRVLARFHGRSRPPLSFNVSLDFVILYFFSDRINQAQGFAVLYQAVKEELPQERPAVNQTVAEVITEQANLSVSAARSSKVLYVITTSPSHPPQTVPGSNSWAPPMGAGSHRVEGWT

SEQ ID NO: 2630 - protein, 364 aa, synthetic construct
  REGION 1..364: note = KREMEN2 (Q8NCW0) SP+PP+ECD
MGTQALQGFLFLLFLPLLQPRGASAGSLHSPGLSECFQVNGADYRGHQNRTGPRGAGRPCLFWDQTQQHSYSSASDPHGRWGLGAHNFCRNPDGDVQPWCYVAETEEGIYWRYCDIPSCHMPGYLGCFVDSGAPPALSGPSGTSTKLTVQVCLRFCRMKGYQLAGVEAGYACFCGSESDLARGRLAPATDCDQICFGHPGQLCGGDGRLGVYEVSVGSCQGNWTAPQGVIYSPDFPDEYGPDRNCSWALGPPGAALELTFRLFELADPRDRLELRDAASGSLLRAFDGARPPPSGPLRLGTAALLLTFRSDARGHAQGFALTYRGLQDAAEDPEAPEGSAQTPAAPLDGANVSCSPRPGAPPAA

SEQ ID NO: 2631 - protein, 1120 aa, synthetic construct
  REGION 1..1120: note = L1CAM (P32004) SP+PP+ECD
MVVALRYVWPLLLCSPCLLIQIPEEYEGHHVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATE

SEQ ID NO: 2632 - protein, 450 aa, synthetic construct
  REGION 1..450: note = LAG3 (P18627) SP+PP+ECD
MWEAQFLGLLFLQPLWVAPVKPLQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHL

SEQ ID NO: 2633 - protein, 165 aa, synthetic construct
  REGION 1..165: note = LAIR1 (Q6GTX8) SP+PP+ECD
MSPHPTALLGLVLCLAQTIHTQEEDLPRPSISAEPGTVIPLGSHVTFVCRGPVGVQTFRLERESRSTYNDTEDVSQASPSESEARFRIDSVSEGNAGPYRCIYYKPPKWSEQSDYLELLVKETSGGPDSPDTEPGSSAGPTQRPSDNSHNEHAPASQGLKAEHLY

SEQ ID NO: 2634 - protein, 382 aa, synthetic construct
  REGION 1..382: note = LAMP1 (P11279) SP+PP+ECD
MAAPGSARRPLLLLLLLLLLGLMHCASAAMFMVKNGNGTACIMANFSAAFSVNYDTKSGPKNMTFDLPSDATVVLNRSSCGKENTSDPSLVIAFGRGHTLTLNFTRNATRYSVQLMSFVYNLSDTHLFPNASSKEIKTVESITDIRADIDKKYRCVSGTQVHMNNVTVTLHDATIQAYLSNSSFSRGETRCEQDRPSPTTAPPAPPSPSPSPVPKSPSVDKYNVSGTNGTCLLASMGLQLNLTYERKDNTTVTRLLNINPNKTSASGSCGAHLVTLELHSEGTTVLLFQFGMNASSSRFFLQGIQLNTILPDARDPAFKAANGSLRALQATVGNSYKCNAEEHVRVTKAFSVNIFKVWVQAFKVEGGQFGSVEECLLDENSM

SEQ ID NO: 2635 - protein, 375 aa, synthetic construct
  REGION 1..375: note = LAMP2 (P13473) SP+PP+ECD
MVCFRLFPVPGSGLVLVCLVLGAVRSYALELNLTDSENATCLYAKWQMNFTVRYETTNKTYKTVTISDHGTVTYNGSICGDDQNGPKIAVQFGPGFSWIANFTKAASTYSIDSVSFSYNTGDNTTFPDAEDKGILTVDELLAIRIPLNDLFRCNSLSTLEKNDVVQHYWDVLVQAFVQNGTVSTNEFLCDKDKTSTVAPTIHTTVPSPTTTPTPKEKPEAGTYSVNNGNDTCLLATMGLQLNITQDKVASVININPNTTHSTGSCRSHTALLRLNSSTIKYLDFVFAVKNENRFYLKEVNISMYLVNGSVFSIANNNLSYWDAPLGSSYMCNKEQTVSVSGAFQINTFDLRVQPFNVTQGKYSTAQDCSADDDNF

SEQ ID NO: 2636 - protein, 381 aa, synthetic construct
  REGION 1..381: note = LAMP3 (Q9UQV4) SP+PP+ECD
MPRQLSAAAALFASLAVILHDGSQMRAKAFPETRDYSQPTAAATVQDIKKPVQQPAKQAPHQTLAARFMDGHITFQTAATVKIPTTTPATTKNTATTSPITYTLVTTQATPNNSHTAPPVTEVTVGPSLAPYSLPPTITPPAHTTGTSSSTVSHTTGNTTQPSNQTTLPATLSIALHKSTTGQKPVQPTHAPGTTAAAHNTTRTAAPASTVPGPTLAPQPSSVKTGIYQVLNGSRLCIKAEMGIQLIVQDKESVFSPRRYFNIDPNATQASGNCGTRKSNLLLNFQGGFVNLTFTKDEESYYISEVGAYLTVSDPETIYQGIKHAVVMFQTAVGHSFKCVSEQSLQLSAHLQVKTTDVQLQAFDFEDDHFGNVDECSSDYT

SEQ ID NO: 2637 - protein, 235 aa, synthetic construct
  REGION 1..235: note = LAMP5 (Q9UJQ1) SP+PP+ECD
MDLQGRGVPSIDRLRVLLMLFHTMAQIMAEQEVENLSGLSTNPEKDIFVVRENGTTCLMAEFAAKFIVPYDVWASNYVDLITEQADIALTRGAEVKGRCGHSQSELQVFWVDRAYALKMLFVKESHNMSKGPEATWRLSKVQFVYDSSEKTHFKDAVSAGKHTANSHHLSALVTPAGKSYECQAQQTISLASSDPQKTVTMILSAVHIQPFDIISDFVFSEEHKCPVDEREQLEE

SEQ ID NO: 2638 - protein, 235 aa, synthetic construct
  REGION 1..235: note = LAYN (Q6UX15) SP+PP+ECD
MRPGTALQAVLLAVLLVGLRAATGRLLSASDLDLRGGQPVCRGGTQRPCYKVIYFHDTSRRLNFEEAKEACRRDGGQLVSIESEDEQKLIEKFIENLLPSDGDFWIGLRRREEKQSNSTACQDLYAWTDGSISQFRNWYVDEPSCGSEVCVVMYHQPSAPAGIGGPYMFQWNDDRCNMKNNFICKYSDEKPAVPSREAEGEETELTTPVLPEETQEEDAKKTFKESREAALNLAY

SEQ ID NO: 2639 - protein, 2731 aa, synthetic construct
  REGION 1..2731: note = LCT (P09848) SP+PP+ECD
MELSWHVVFIALLSFSCWGSDWESDRNFISTAGPLTNDLLHNLSGLLGDQSSNFVAGDKDMYVCHQPLPTFLPEYFSSLHASQITHYKVFLSWAQLLPAGSTQNPDEKTVQCYRRLLKALKTARLQPMVILHHQTLPASTLRRTEAFADLFADYATFAFHSFGDLVGIWFTFSDLEEVIKELPHQESRASQLQTLSDAHRKAYEIYHESYAFQGGKLSVVLRAEDIPELLLEPPISALAQDTVDFLSLDLSYECQNEASLRQKLSKLQTIEPKVKVFIFNLKLPDCPSTMKNPASLLFSLFEAINKDQVLTIGFDINEFLSCSSSSKKSMSCSLTGSLALQPDQQQDHETTDSSPASAYQRIWEAFANQSRAERDAFLQDTFPEGFLWGASTGAFNVEGGWAEGGRGVSIWDPRRPLNTTEGQATLEVASDSYHKVASDVALLCGLRAQVYKFSISWSRIFPMGHGSSPSLPGVAYYNKLIDRLQDAGIEPMATLFHWDLPQALQDHGGWQNESVVDAFLDYAAFCFSTFGDRVKLWVTFHEPWVMSYAGYGTGQHPPGISDPGVASFKVAHLVLKAHARTWHHYNSHHRPQQQGHVGIVLNSDWAEPLSPERPEDLRASERFLHFMLGWFAHPVFVDGDYPATLRTQIQQMNRQCSHPVAQLPEFTEAEKQLLKGSADFLGLSHYTSRLISNAPQNTCIPSYDTIGGFSQHVNHVWPQTSSSWIRVVPWGIRRLLQFVSLEYTRGKVPIYLAGNGMPIGESENLFDDSLRVDYFNQYINEVLKAIKEDSVDVRSYIARSLIDGFEGPSGYSQRFGLHHVNFSDSSKSRTPRKSAYFFTSIIEKNGFLTKGAKRLLPPNTVNLPSKVRSDWESDRNFISTAGPLTNDLLHNLSGLLGDQSSNFVAGDKDMYVCHQPLPTFLPEYFSSLHASQITHYKVFLSWAQLLPAGSTQNPDEKTVQCYRRLLKALKTARLQPMVILHHQTLPASTLRRTEAFADLFADYATFAFHSFGDLVGIWFTFSDLEEVIKELPHQESRASQLQTLSDAHRKAYEIYHESYAFQGGKLSVVLRAEDIPELLLEPPISALAQDTVDFLSLDLSYECQNEASLRQKLSKLQTIEPKVKVFIFNLKLPDCPSTMKNPASLLFSLFEAINKDQVLTIGFDINEFLSCSSSSKKSMSCSLTGSLALQPDQQQDHETTDSSPASAYQRIWEAFANQSRAERDAFLQDTFPEGFLWGASTGAFNVEGGWAEGGRGVSIWDPRRPLNTTEGQATLEVASDSYHKVASDVALLCGLRAQVYKFSISWSRIFPMGHGSSPSLPGVAYYNKLIDRLQDAGIEPMATLFHWDLPQALQDHGGWQNESVVDAFLDYAAFCFSTFGDRVKLWVTFHEPWVMSYAGYGTGQHPPGISDPGVASFKVAHLVLKAHARTWHHYNSHHRPQQQGHVGIVLNSDWAEPLSPERPEDLRASERFLHFMLGWFAHPVFVDGDYPATLRTQIQQMNRQCSHPVAQLPEFTEAEKQLLKGSADFLGLSHYTSRLISNAPQNTCIPSYDTIGGFSQHVNHVWPQTSSSWIRVVPWGIRRLLQFVSLEYTRGKVPIYLAGNGMPIGESENLFDDSLRVDYFNQYINEVLKAIKEDSVDVRSYIARSLIDGFEGPSGYSQRFGLHHVNFSDSSKSRTPRKSAYFFTSIIEKNGFLTKGAKRLLPPNTVNLPSKVRAFTFPSEVPSKAKVVWEKFSSQPKFERDLFYHGTFRDDFLWGVSSSAYQIEGAWDADGKGPSIWDNFTHTPGSNVKDNATGDIACDSYHQLDADLNMLRALKVKAYRFSISWSRIFPTGRNSSINSHGVDYYNRLINGLVASNIFPMVTLFHWDLPQALQDIGGWENPALIDLFDSYADFCFQTFGDRVKFWMTFNEPMYLAWLGYGSGEFPPGVKDPGWAPYRIAHAVIKAHARVYHTYDEKYRQEQKGVISLSLSTHWAEPKSPGVPRDVEAADRMLQFSLGWFAHPIFRNGDYPDTMKWKVGNRSELQHLATSRLPSFTEEEKRFIRATADVFCLNTYYSRIVQHKTPRLNPPSYEDDQEMAEEEDPSWPSTAMNRAAPWGTRRLLNWIKEEYGDIPIYITENGVGLTNPNTEDTDRIFYHKTYINEALKAYRLDGIDLRGYVAWSLMDNFEWLNGYTVKFGLYHVDFNNTNRPRTARASARYYTEVITNNGMPLAREDEFLYGRFPEGFIWSAASAAYQIEGAWRADGKGLSIWDTFSHTPLRVENDAIGDVACDSYHKIAEDLVTLQNLGVSHYRFSISWSRILPDGTTRYINEAGLNYYVRLIDTLLAASIQPQVTIYHWDLPQTLQDVGGWENETIVQRFKEYADVLFQRLGDKVKFWITLNEPFVIAYQGYGYGTAAPGVSNRPGTAPYIVGHNLIKAHAEAWHLYNDVYRASQGGVISITISSDWAEPRDPSNQEDVEAARRYVQFMGGWFAHPIFKNGDYNEVMKTRIRDRSLAAGLNKSRLPEFTESEKRRINGTYDFFGFNHYTTVLAYNLNYATAISSFDADRGVASIADRSWPDSGSFWLKMTPFGFRRILNWLKEEYNDPPIYVTENGVSQREETDLNDTARIYYLRTYINEALKAVQDKVDLRGYTVWSAMDNFEWATGFSERFGLHFVNYSDPSLPRIPKASAKFYASVVRCNGFPDPATGPHACLHQPDAGPTISPVRQEEVQFLGLMLGTTEAQT

SEQ ID NO: 2640 - protein, 788 aa, synthetic construct
  REGION 1..788: note = LDLR (P01130) SP+PP+ECD
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVR

SEQ ID NO: 2641 - protein, 173 aa, synthetic construct
  REGION 1..173: note = LDLRAD3 (Q86YD5) SP+PP+ECD
MWLLGPLCLLLSSAAESQLLPGNNFTNECNIPGNFMCSNGRCIPGAWQCDGLPDCFDKSDEKECPKAKSKCGPTFFPCASGIHCIIGRFRCNGFEDCPDGSDEENCTANPLLCSTARYHCKNGLCIDKSFICDGQNNCQDNSDEESCESSQEPGSGQVFVTSENQLVYYPSIT

SEQ ID NO: 2642 - protein, 839 aa, synthetic construct
  REGION 1..839: note = LEPR (P48357) SP+PP+ECD
MICQKFCVVLLHWEFIYVITAFNLSYPITPWRFKLSCMPPNSTYDYFLLPAGLSKNTSNSNGHYETAVEPKFNSSGTHFSNLSKTTFHCCFRSEQDRNCSLCADNIEGKTFVSTVNSLVFQQIDANWNIQCWLKGDLKLFICYVESLFKNLFRNYNYKVHLLYVLPEVLEDSPLVPQKGSFQMVHCNCSVHECCECLVPVPTAKLNDTLLMCLKITSGGVIFQSPLMSVQPINMVKPDPPLGLHMEITDDGNLKISWSSPPLVPFPLQYQVKYSENSTTVIREADKIVSATSLLVDSILPGSSYEVQVRGKRLDGPGIWSDWSTPRVFTTQDVIYFPPKILTSVGSNVSFHCIYKKENKIVPSKEIVWWMNLAEKIPQSQYDVVSDHVSKVTFFNLNETKPRGKFTYDAVYCCNEHECHHRYAELYVIDVNINISCETDGYLTKMTCRWSTSTIQSLAESTLQLRYHRSSLYCSDIPSIHPISEPKDCYLQSDGFYECIFQPIFLLSGYTMWIRINHSLGSLDSPPTCVLPDSVVKPLPPSSVKAEITINIGLLKISWEKPVFPENNLQFQIRYGLSGKEVQWKMYEVYDAKSKSVSLPVPDLCAVYAVQVRCKRLDGLGYWSNWSNPAYTVVMDIKVPMRGPEFWRIINGDTMKKEKNVTLLWKPLMKNDSLCSVQRYVINHHTSCNGTWSEDVGNHTKFTFLWTEQAHTVTVLAINSIGASVANFNLTFSWPMSKVNIVQSLSAYPLNSSCVIVSWILSPSDYKLMYFIIEWKNLNEDGEIKWLRISSSVKKYYIHDHFIPIEKYQFSLYPIFMEGVGKPKIINSFTQDDIEKHQSD

SEQ ID NO: 2643 - protein, 833 aa, synthetic construct
  REGION 1..833: note = LIFR (P42702) SP+PP+ECD
MMDIYVCLKRPSWMVDNKRMRTASNFQWLLSTFILLYLMNQVNSQKKGAPHDLKCVTNNLQVWNCSWKAPSGTGRGTDYEVCIENRSRSCYQLEKTSIKIPALSHGDYEITINSLHDFGSSTSKFTLNEQNVSLIPDTPEILNLSADFSTSTLYLKWNDRGSVFPHRSNVIWEIKVLRKESMELVKLVTHNTTLNGKDTLHHWSWASDMPLECAIHFVEIRCYIDNLHFSGLEEWSDWSPVKNISWIPDSQTKVFPQDKVILVGSDITFCCVSQEKVLSALIGHTNCPLIHLDGENVAIKIRNISVSASSGTNVVFTTEDNIFGTVIFAGYPPDTPQQLNCETHDLKEIICSWNPGRVTALVGPRATSYTLVESFSGKYVRLKRAEAPTNESYQLLFQMLPNQEIYNFTLNAHNPLGRSQSTILVNITEKVYPHTPTSFKVKDINSTAVKLSWHLPGNFAKINFLCEIEIKKSNSVQEQRNVTIKGVENSSYLVALDKLNPYTLYTFRIRCSTETFWKWSKWSNKKQHLTTEASPSKGPDTWREWSSDGKNLIIYWKPLPINEANGKILSYNVSCSSDEETQSLSEIPDPQHKAEIRLDKNDYIISVVAKNSVGSSPPSKIASMEIPNDDLKIEQVVGMGKGILLTWHYDPNMTCDYVIKWCNSSRSEPCLMDWRKVPSNSTETVIESDEFRPGIRYNFFLYGCRNQGYQLLRSMIGYIEELAPIVAPNFTVEDTSADSILVKWEDIPVEELRGFLRGYLFYFGKGERDTSKMRVLESGRSDIKVKNITDISQKTLRIADLQGKTSYHLVLRAYTDGGVGPEKSMYVVTKENS

SEQ ID NO: 2644 - protein, 461 aa, synthetic construct
  REGION 1..461: note = LILRA1 (O75019) SP+PP+ECD
MTPIVTVLICLRLSLGPRTHVQAGTLPKPTLWAEPGSVITQGSPVTLWCQGILETQEYRLYREKKTAPWITRIPQEIVKKGQFPIPSITWEHTGRYRCFYGSHTAGWSEPSDPLELVVTGAYIKPTLSALPSPVVTSGGNVTLHCVSQVAFGSFILCKEGEDEHPQCLNSQPRTHGWSRAIFSVGPVSPSRRWSYRCYAYDSNSPHVWSLPSDLLELLVLGVSKKPSLSVQPGPIVAPGESLTLQCVSDVSYDRFVLYKEGERDFLQLPGPQPQAGLSQANFTLGPVSRSYGGQYRCSGAYNLSSEWSAPSDPLDILIAGQFRGRPFISVHPGPTVASGENVTLLCQSWGPFHTFLLTKAGAADAPLRLRSIHEYPKYQAEFPMSPVTSAHSGTYRCYGSLSSNPYLLSHPSDSLELMVSGAAETLSPPQNKSDSKAGAANTLSPSQNKTASHPQDYTVEN

SEQ ID NO: 2645 - protein, 449 aa, synthetic construct
  REGION 1..449: note = LILRA2 (Q8N149) SP+PP+ECD
MTPILTVLICLGLSLGPRTHVQAGHLPKPTLWAEPGSVIIQGSPVTLRCQGSLQAEEYHLYRENKSASWVRRIQEPGKNGQFPIPSITWEHAGRYHCQYYSHNHSSEYSDPLELVVTGAYSKPTLSALPSPVVTLGGNVTLQCVSQVAFDGFILCKEGEDEHPQRLNSHSHARGWSWAIFSVGPVSPSRRWSYRCYAYDSNSPYVWSLPSDLLELLVPGVSKKPSLSVQPGPMVAPGESLTLQCVSDVGYDRFVLYKEGERDFLQRPGWQPQAGLSQANFTLGPVSPSHGGQYRCYSAHNLSSEWSAPSDPLDILITGQFYDRPSLSVQPVPTVAPGKNVTLLCQSRGQFHTFLLTKEGAGHPPLHLRSEHQAQQNQAEFRMGPVTSAHVGTYRCYSSLSSNPYLLSLPSDPLELVVSEAAETLSPSQNKTDSTTTSLGQHPQDYTVEN

SEQ ID NO: 2646 - protein, 446 aa, synthetic construct
  REGION 1..446: note = LILRA4 (P59901) SP+PP+ECD
MTLILTSLLFFGLSLGPRTRVQAENLPKPILWAEPGPVITWHNPVTIWCQGTLEAQGYRLDKEGNSMSRHILKTLESENKVKLSIPSMMWEHAGRYHCYYQSPAGWSEPSDPLELVVTAYSRPTLSALPSPVVTSGVNVTLRCASRLGLGRFTLIEEGDHRLSWTLNSHQHNHGKFQALFPMGPLTFSNRGTFRCYGYENNTPYVWSEPSDPLQLLVSGVSRKPSLLTLQGPVVTPGENLTLQCGSDVGYIRYTLYKEGADGLPQRPGRQPQAGLSQANFTLSPVSRSYGGQYRCYGAHNVSSEWSAPSDPLDILIAGQISDRPSLSVQPGPTVTSGEKVTLLCQSWDPMFTFLLTKEGAAHPPLRLRSMYGAHKYQAEFPMSPVTSAHAGTYRCYGSRSSNPYLLSHPSEPLELVVSGATETLNPAQKKSDSKTAPHLQDYTVEN

SEQ ID NO: 2647 - protein, 268 aa, synthetic construct
  REGION 1..268: note = LILRA5 (A6NI73) SP+PP+ECD
MAPWSHPSAQLQPVGGDAVSPALMVLLCLGLSLGPRTHVQAGNLSKATLWAEPGSVISRGNSVTIRCQGTLEAQEYRLVKEGSPEPWDTQNPLEPKNKARFSIPSMTEHHAGRYRCYYYSPAGWSEPSDPLELVVTGFYNKPTLSALPSPVVTSGENVTLQCGSRLRFDRFILTEEGDHKLSWTLDSQLTPSGQFQALFPVGPVTPSHRWMLRCYGSRRHILQVWSEPSDLLEIPVSGAADNLSPSQNKSDSGTASHLQDYAVENLIR

SEQ ID NO: 2648 - protein, 447 aa, synthetic construct
  REGION 1..447: note = LILRA6 (Q6PI73) SP+PP+ECD
MTPALTALLCLGLSLGPRTRVQAGPFPKPTLWAEPGSVISWGSPVTIWCQGSLEAQEYQLDKEGSPEPLDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPRVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSRGYFDTFLLTKEGAAHPPLRLRSMYGAHKYQAEFPMSPVTSAHAGTYRCYGSYSSNPHLLSFPSEPLELMVSGHSGGSSLPPTGPPSTPASHAKDYTVEN

SEQ ID NO: 2649 - protein, 461 aa, synthetic construct
  REGION 1..461: note = LILRB1 (Q8NHL6) SP+PP+ECD
MTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGLGRHLGV

SEQ ID NO: 2650 - protein, 461 aa, synthetic construct
  REGION 1..461: note = LILRB2 (Q8N423) SP+PP+ECD
MTPIVTVLICLGLSLGPRTHVQTGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEEEHPQCLNSQPHARGSSRAIFSVGPVSPNRRWSHRCYGYDLNSPYVWSSPSDLLELLVPGVSKKPSLSVQPGPVVAPGESLTLQCVSDVGYDRFVLYKEGERDLRQLPGRQPQAGLSQANFTLGPVSRSYGGQYRCYGAHNLSSECSAPSDPLDILITGQIRGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPAGPEDQPLTPTGSDPQSGLGRHLGV

SEQ ID NO: 2651 - protein, 443 aa, synthetic construct
  REGION 1..443: note = LILRB3 (O75022) SP+PP+ECD
MTPALTALLCLGLSLGPRTRVQAGPFPKPTLWAEPGSVISWGSPVTIWCQGSQEAQEYRLHKEGSPEPLDRNNPLEPKNKARFSIPSMTEHHAGRYRCHYYSSAGWSEPSDPLEMVMTGAYSKPTLSALPSPVVASGGNMTLRCGSQKGYHHFVLMKEGEHQLPRTLDSQQLHSRGFQALFPVGPVTPSHRWRFTCYYYYTNTPWVWSHPSDPLEILPSGVSRKPSLLTLQGPVLAPGQSLTLQCGSDVGYNRFVLYKEGERDFLQRPGQQPQAGLSQANFTLGPVSPSNGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSHPSEPLELVVSGHSGGSSLPPTGPPSTPGLGRYLE

SEQ ID NO: 2652 - protein, 458 aa, synthetic construct
  REGION 1..458: note = LILRB5 (O75023) SP+PP+ECD
MTLTLSVLICLGLSVGPRTCVQAGTLPKPTLWAEPASVIARGKPVTLWCQGPLETEEYRLDKEGLPWARKRQNPLEPGAKAKFHIPSTVYDSAGRYRCYYETPAGWSEPSDPLELVATGFYAEPTLLALPSPVVASGGNVTLQCDTLDGLLTFVLVEEEQKLPRTLYSQKLPKGPSQALFPVGPVTPSCRWRFRCYYYYRKNPQVWSNPSDLLEILVPGVSRKPSLLIPQGSVVARGGSLTLQCRSDVGYDIFVLYKEGEHDLVQGSGQQPQAGLSQANFTLGPVSRSHGGQYRCYGAHNLSPRWSAPSDPLDILIAGLIPDIPALSVQPGPKVASGENVTLLCQSWHQIDTFFLTKEGAAHPPLCLKSKYQSYRHQAEFSMSPVTSAQGGTYRCYSAIRSYPYLLSSPSYPQELVVSGPSGDPSLSPTGSTPTPGPEDQPLTPTGLDPQSGLGRHLG

SEQ ID NO: 2653 - protein, 561 aa, synthetic construct
  REGION 1..561: note = LINGO1 (Q96FE5) SP+PP+ECD
MQVSKRMLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRLKLIPLGVFTGLSNLTKLDISENKIVILLDYMFQDLYNLKSLEVGDNDLVYISHRAFSGLNSLEQLTLEKCNLTSIPTEALSHLHGLIVLRLRHLNINAIRDYSFKRLYRLKVLEISHWPYLDTMTPNCLYGLNLTSLSITHCNLTAVPYLAVRHLVYLRFLNLSYNPISTIEGSMLHELLRLQEIQLVGGQLAVVEPYAFRGLNYLRVLNVSGNQLTTLEESVFHSVGNLETLILDSNPLACDCRLLWVFRRRWRLNFNRQQPTCATPEFVQGKEFKDFPDVLLPNYFTCRRARIRDRKAQQVFVDEGHTVQFVCRADGDPPPAILWLSPRKHLVSAKSNGRLTVFPDGTLEVRYAQVQDNGTYLCIAANAGGNDSMPAHLHVRSYSPDWPHQPNKTFAFISNQPGEGEANSTRATVPFPFDIKTLIIAT

SEQ ID NO: 2654 - protein, 545 aa, synthetic construct
  REGION 1..545: note = LINGO2 (Q7L985) SP+PP+ECD
MLHTAISCWQPFLGLAVVLIFMGSTIGCPARCECSAQNKSVSCHRRRLIAIPEGIPIETKILDLSKNRLKSVNPEEFISYPLLEEIDLSDNIIANVEPGAFNNLFNLRSLRLKGNRLKLVPLGVFTGLSNLTKLDISENKIVILLDYMFQDLHNLKSLEVGDNDLVYISHRAFSGLLSLEQLTLEKCNLTAVPTEALSHLRSLISLHLKHLNINNMPVYAFKRLFHLKHLEIDYWPLLDMMPANSLYGLNLTSLSVTNTNLSTVPFLAFKHLVYLTHLNLSYNPISTIEAGMFSDLIRLQELHIVGAQLRTIEPHSFQGLRFLRVLNVSQNLLETLEENVFSSPRALEVLSINNNPLACDCRLLWILQRQPTLQFGGQQPMCAGPDTIRERSFKDFHSTALSFYFTCKKPKIREKKLQHLLVDEGQTVQLECSADGDPQPVISWVTPRRRFITTKSNGRATVLGDGTLEIRFAQDQDSGMYVCIASNAAGNDTFTASLTVKGFASDRFLYANRTPMYMTDSNDTISNGTNANTFSLDLKTILVST

SEQ ID NO: 2655 - protein, 531 aa, synthetic construct
  REGION 1..531: note = LINGO3 (P0C6S8) SP+PP+ECD
MTCWLCVLSLPLLLLPAAPPPAGGCPARCECTVQTRAVACTRRRLTAVPDGIPAETRLLELSRNRIRCLNPGDLAALPALEELDLSENAIAHVEPGAFANLPRLRVLRLRGNQLKLIPPGVFTRLDNLTLLDLSENKLVILLDYTFQDLHSLRRLEVGDNDLVFVSRRAFAGLLALEELTLERCNLTALSGESLGHLRSLGALRLRHLAIASLEDQNFRRLPGLLHLEIDNWPLLEEVAAGSLRGLNLTSLSVTHTNITAVPAAALRHQAHLTCLNLSHNPISTVPRGSFRDLVRLRELHLAGALLAVVEPQAFLGLRQIRLLNLSNNLLSTLEESTFHSVNTLETLRVDGNPLACDCRLLWIVQRRKTLNFDGRLPACATPAEVRGDALRNLPDSVLFEYFVCRKPKIRERRLQRVTATAGEDVRFLCRAEGEPAPTVAWVTPQHRPVTATSAGRARVLPGGTLEIQDARPQDSGTYTCVASNAGGNDTYFATLTVRPEPAANRTPGEAHNETLAALRAPLDLTTILVST

SEQ ID NO: 2656 - protein, 533 aa, synthetic construct
  REGION 1..533: note = LINGO4 (Q6UY18) SP+PP+ECD
MDAATAPKQAWPPWPPLLFLLLLPGGSGGSCPAVCDCTSQPQAVLCGHRQLEAVPGGLPLDTELLDLSGNRLWGLQQGMLSRLSLLQELDLSYNQLSTLEPGAFHGLQSLLTLRLQGNRLRIMGPGVFSGLSALTLLDLRLNQIVLFLDGAFGELGSLQKLEVGDNHLVFVAPGAFAGLAKLSTLTLERCNLSTVPGLALARLPALVALRLRELDIGRLPAGALRGLGQLKELEIHLWPSLEALDPGSLVGLNLSSLAITRCNLSSVPFQALYHLSFLRVLDLSQNPISAIPARRLSPLVRLQELRLSGACLTSIAAHAFHGLTAFHLLDVADNALQTLEETAFPSPDKLVTLRLSGNPLTCDCRLLWLLRLRRHLDFGMSPPACAGPHHVQGKSLKEFSDILPPGHFTCKPALIRKSGPRWVIAEEGGHAVFSCSGDGDPAPTVSWMRPHGAWLGRAGRVRVLEDGTLEIRSVQLRDRGAYVCVVSNVAGNDSLRTWLEVIQVEPPNGTLSDPNITVPGIPGPFFLDSRGVA

SEQ ID NO: 2657 - protein, 322 aa, synthetic construct
  REGION 1..322: note = LMAN2 (Q12907) SP+PP+ECD
MAAEGWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDLSDNHDIISMKLFQLMVEHTPDEESIDWTKIEPSVNFLKSPKDNVDDPTGNFRSGPLTGWR

SEQ ID NO: 2658 - protein, 313 aa, synthetic construct
  REGION 1..313: note = LMAN2L (Q9H0V9) SP+PP+ECD
MAATLGPLGSWQQWRRCLSARDGSRMLLLLLLLGSGQGPQQVGAGQTFEYLKREHSLSKPYQGVGTGSSSLWNLMGNAMVMTQYIRLTPDMQSKQGALWNRVPCFLRDWELQVHFKIHGQGKKNLHGDGLAIWYTKDRMQPGPVFGNMDKFVGLGVFVDTYPNEEKQQERVFPYISAMVNNGSLSYDHERDGRPTELGGCTAIVRNLHYDTFLVIRYVKRHLTIMMDIDGKHEWRDCIEVPGVRLPRGYYFGTSSITGDLSDNHDVISLKLFELTVERTPEEEKLHRDVFLPSVDNMKLPEMTAPLPPLSGLA

SEQ ID NO: 2659 - protein, 536 aa, synthetic construct
  REGION 1..536: note = LRFN1 (Q9P244) SP+PP+ECD
MAPGPFSSALLSPPPAALPFLLLLWAGASRGQPCPGRCICQNVAPTLTMLCAKTGLLFVPPAIDRRVVELRLTDNFIAAVRRRDFANMTSLVHLTLSRNTIGQVAAGAFADLRALRALHLDSNRLAEVRGDQLRGLGNLRHLILGNNQIRRVESAAFDAFLSTVEDLDLSYNNLEALPWEAVGQMVNLNTLTLDHNLIDHIAEGTFVQLHKLVRLDMTSNRLHKLPPDGLFLRSQGTGPKPPTPLTVSFGGNPLHCNCELLWLRRLTREDDLETCATPEHLTDRYFWSIPEEEFLCEPPLITRQAGGRALVVEGQAVSLRCRAVGDPEPVVHWVAPDGRLLGNSSRTRVRGDGTLDVTITTLRDSGTFTCIASNAAGEATAPVEVCVVPLPLMAPPPAAPPPLTEPGSSDIATPGRPGANDSAAERRLVAAELTSNSVLIRWPAQRPVPGIRMYQVQYNSSVDDSLVYRMIPSTSQTFLVNDLAAGRAYDLCVLAVYDDGATALPATRVVGCVQFTTAGDPAPCRPLRAHFLGGTM

SEQ ID NO: 2660 - protein, 534 aa, synthetic construct
  REGION 1..534: note = LRFN2 (Q9ULH4) SP+PP+ECD
METLLGGLLAFGMAFAVVDACPKYCVCQNLSESLGTLCPSKGLLFVPPDIDRRTVELRLGGNFIIHISRQDFANMTGLVDLTLSRNTISHIQPFSFLDLESLRSLHLDSNRLPSLGEDTLRGLVNLQHLIVNNNQLGGIADEAFEDFLLTLEDLDLSYNNLHGLPWDSVRRMVNLHQLSLDHNLLDHIAEGTFADLQKLARLDLTSNRLQKLPPDPIFARSQASALTATPFAPPLSFSFGGNPLHCNCELLWLRRLERDDDLETCGSPGGLKGRYFWHVREEEFVCEPPLITQHTHKLLVLEGQAATLKCKAIGDPSPLIHWVAPDDRLVGNSSRTAVYDNGTLDIFITTSQDSGAFTCIAANAAGEATAMVEVSIVQLPHLSNSTSRTAPPKSRLSDITGSSKTSRGGGGSGGGEPPKSPPERAVLVSEVTTTSALVKWSVSKSAPRVKMYQLQYNCSDDEVLIYRMIPASNKAFVVNNLVSGTGYDLCVLAMWDDTATTLTATNIVGCAQFFTKADYPQCQSMHSQILGGTM

SEQ ID NO: 2661 - protein, 539 aa, synthetic construct
  REGION 1..539: note = LRFN3 (Q9BTN0) SP+PP+ECD
MAILPLLLCLLPLAPASSPPQSATPSPCPRRCRCQTQSLPLSVLCPGAGLLFVPPSLDRRAAELRLADNFIASVRRRDLANMTGLLHLSLSRNTIRHVAAGAFADLRALRALHLDGNRLTSLGEGQLRGLVNLRHLILSNNQLAALAAGALDDCAETLEDLDLSYNNLEQLPWEALGRLGNVNTLGLDHNLLASVPAGAFSRLHKLARLDMTSNRLTTIPPDPLFSRLPLLARPRGSPASALVLAFGGNPLHCNCELVWLRRLAREDDLEACASPPALGGRYFWAVGEEEFVCEPPVVTHRSPPLAVPAGRPAALRCRAVGDPEPRVRWVSPQGRLLGNSSRARAFPNGTLELLVTEPGDGGIFTCIAANAAGEATAAVELTVGPPPPPQLANSTSCDPPRDGDPDALTPPSAASASAKVADTGPPTDRGVQVTEHGATAALVQWPDQRPIPGIRMYQIQYNSSADDILVYRMIPAESRSFLLTDLASGRTYDLCVLAVYEDSATGLTATRPVGCARFSTEPALRPCGAPHAPFLGGTM

SEQ ID NO: 2662 - protein, 518 aa, synthetic construct
  REGION 1..518: note = LRFN4 (Q6PJG9) SP+PP+ECD
MAPPLLLLLLASGAAACPLPCVCQNLSESLSTLCAHRGLLFVPPNVDRRTVELRLADNFIQALGPPDFRNMTGLVDLTLSRNAITRIGARAFGDLESLRSLHLDGNRLVELGTGSLRGPVNLQHLILSGNQLGRIAPGAFDDFLESLEDLDLSYNNLRQVPWAGIGAMPALHTLNLDHNLIDALPPGAFAQLGQLSRLDLTSNRLATLAPDPLFSRGRDAEASPAPLVLSFSGNPLHCNCELLWLRRLARPDDLETCASPPGLAGRYFWAVPEGEFSCEPPLIARHTQRLWVLEGQRATLRCRALGDPAPTMHWVGPDDRLVGNSSRARAFPNGTLEIGVTGAGDAGGYTCIATNPAGEATARVELRVLALPHGGNSSAEGGRPGPSDIAASARTAAEGEGTLESEPAVQVTEVTATSGLVSWGPGRPADPVWMFQIQYNSSEDETLIYRIVPASSHHFLLKHLVPGADYDLCLLALSPAAGPSDLTATRLLGCAHFSTLPASPLCHALQAHVLGGTL

SEQ ID NO: 2663 - protein, 529 aa, synthetic construct
  REGION 1..529: note = LRFN5 (Q96NI6) SP+PP+ECD
MEKILFYLFLIGIAVKAQICPKRCVCQILSPNLATLCAKKGLLFVPPNIDRRTVELRLADNFVTNIKRKDFANMTSLVDLTLSRNTISFITPHAFADLRNLRALHLNSNRLTKITNDMFSGLSNLHHLILNNNQLTLISSTAFDDVFALEELDLSYNNLETIPWDAVEKMVSLHTLSLDHNMIDNIPKGTFSHLHKMTRLDVTSNKLQKLPPDPLFQRAQVLATSGIISPSTFALSFGGNPLHCNCELLWLRRLSREDDLETCASPPLLTGRYFWSIPEEEFLCEPPLITRHTHEMRVLEGQRATLRCKARGDPEPAIHWISPEGKLISNATRSLVYDNGTLDILITTVKDTGAFTCIASNPAGEATQIVDLHIIKLPHLLNSTNHIHEPDPGSSDISTSTKSGSNTSSSNGDTKLSQDKIVVAEATSSTALLKFNFQRNIPGIRMFQIQYNGTYDDTLVYRMIPPTSKTFLVNNLAAGTMYDLCVLAIYDDGITSLTATRVVGCIQFTTEQDYVRCHFMQSQFLGGTM

SEQ ID NO: 2664 - protein, 794 aa, synthetic construct
  REGION 1..794: note = LRIG1 (Q96JA1) SP+PP+ECD
MARPVRGGLGAPRRSPCLLLLWLLLLRLEPVTAAAGPRAPCAAACTCAGDSLDCGGRGLAALPGDLPSWTRSLNLSYNKLSEIDPAGFEDLPNLQEVYLNNNELTAVPSLGAASSHVVSLFLQHNKIRSVEGSQLKAYLSLEVLDLSLNNITEVRNTCFPHGPPIKELNLAGNRIGTLELGAFDGLSRSLLTLRLSKNRITQLPVRAFKLPRLTQLDLNRNRIRLIEGLTFQGLNSLEVLKLQRNNISKLTDGAFWGLSKMHVLHLEYNSLVEVNSGSLYGLTALHQLHLSNNSIARIHRKGWSFCQKLHELVLSFNNLTRLDEESLAELSSLSVLRLSHNSISHIAEGAFKGLRSLRVLDLDHNEISGTIEDTSGAFSGLDSLSKLTLFGNKIKSVAKRAFSGLEGLEHLNLGGNAIRSVQFDAFVKMKNLKELHISSDSFLCDCQLKWLPPWLIGRMLQAFVTATCAHPESLKGQSIFSVPPESFVCDDFLKPQIITQPETTMAMVGKDIRFTCSAASSSSSPMTFAWKKDNEVLTNADMENFVHVHAQDGEVMEYTTILHLRQVTFGHEGRYQCVITNHFGSTYSHKARLTVNVLPSFTKTPHDITIRTTTMARLECAATGHPNPQIAWQKDGGTDFPAARERRMHVMPDDDVFFITDVKIDDAGVYSCTAQNSAGSISANATLTVLETPSLVVPLEDRVVSVGETVALQCKATGNPPPRITWFKGDRPLSLTERHHLTPDNQLLVVQNVVAEDAGRYTCEMSNTLGTERAHSQLSVLPAAGCRKDGTTVG

SEQ ID NO: 2665 - protein, 807 aa, synthetic construct
  REGION 1..807: note = LRIG2 (O94898) SP+PP+ECD
MAPAPLGVPEEQLLGCRSRVLSRLLFIAQTALLLLPAAGAGLCPAPCSCRIPLLDCSRRKLPAPSWRALSGLLPPDTAILDFSHNRLSNWNISLESQTLQEVKMNYNELTEIPYFGEPTSNITLLSLVHNIIPEINAQALQFYPALESLDLSSNIISEIKTSSFPRMQLKYLNLSNNRITTLEAGCFDNLSSSLLVVKLNRNRMSMIPPKIFKLPHLQFLELKRNRIKIVEGLTFQGLDSLRSLKMQRNGISKLKDGAFFGLNNMEELELEHNNLTRVNKGWLYGLRMLQQLYVSQNAIERISPDAWEFCQRLSELDLSYNQLTRLDESAFVGLSLLERLNLGDNRVTHIADGVFRFLSNLQTLDLRNNEISWAIEDASEAFAGLTSLTKLILQGNQIKSITKKAFIGLESLEHLDLNNNAIMSIQENAFSQTHLKELILNTSSLLCDCHLKWLLQWLVDNNFQHSVNVSCAHPEWLAGQSILNVDLKDFVCDDFLKPQIRTHPETIIALRGMNVTLTCTAVSSSDSPMSTVWRKDSEILYDVDTENFVRYWQQAGEALEYTSILHLFNVNFTDEGKYQCIVTNHFGSNYSQKAKLTVNEMPSFLKTPMDLTIRTGAMARLECAAEGHPAPQISWQKDGGTDFPAARERRMHVMPEDDVFFIANVKIEDMGIYSCMAQNTAGGLSANASLTVLETPSFIRPLEDKTVTRGETAVLQCIAGGSPAPRLNWTKDDGPLLVTERHFFAAANQLLIIVDAGLEDAGKYTCIMSNTLGTERGHIYLNVISSPNCDSSQSSIGHEDDGWTTVG

SEQ ID NO: 2666 - protein, 809 aa, synthetic construct
  REGION 1..809: note = LRIG3 (Q6UXM1) SP+PP+ECD
MSAPSLRARAAGLGLLLCAVLGRAGRSDSGGRGELGQPSGVAAERPCPTTCRCLGDLLDCSRKRLARLPEPLPSWVARLDLSHNRLSFIKASSMSHLQSLREVKLNNNELETIPNLGPVSANITLLSLAGNRIVEILPEHLKEFQSLETLDLSSNNISELQTAFPALQLKYLYLNSNRVTSMEPGYFDNLANTLLVLKLNRNRISAIPPKMFKLPQLQHLELNRNKIKNVDGLTFQGLGALKSLKMQRNGVTKLMDGAFWGLSNMEILQLDHNNLTEITKGWLYGLLMLQELHLSQNAINRISPDAWEFCQKLSELDLTFNHLSRLDDSSFLGLSLLNTLHIGNNRVSYIADCAFRGLSSLKTLDLKNNEISWTIEDMNGAFSGLDKLRRLILQGNRIRSITKKAFTGLDALEHLDLSDNAIMSLQGNAFSQMKKLQQLHLNTSSLLCDCQLKWLPQWVAENNFQSFVNASCAHPQLLKGRSIFAVSPDGFVCDDFPKPQITVQPETQSAIKGSNLSFICSAASSSDSPMTFAWKKDNELLHDAEMENYAHLRAQGGEVMEYTTILRLREVEFASEGKYQCVISNHFGSSYSVKAKLTVNMLPSFTKTPMDLTIRAGAMARLECAAVGHPAPQIAWQKDGGTDFPAARERRMHVMPEDDVFFIVDVKIEDIGVYSCTAQNSAGSISANATLTVLETPSFLRPLLDRTVTKGETAVLQCIAGGSPPPKLNWTKDDSPLVVTERHFFAAGNQLLIIVDSDVSDAGKYTCEMSNTLGTERGNVRLSVIPTPTCDSPQMTAPSLDDDGWATVG

SEQ ID NO: 2667 - protein, 526 aa, synthetic construct
  REGION 1..526: note = LRIT1 (Q9P2V4) SP+PP+ECD
MRVALGMLWLLALAWPPQARGFCPSQCSCSLHIMGDGSKARTVVCNDPDMTLPPASIPPDTSRLRLERTAIRRVPGEAFRPLGRLEQLWLPYNALSELNALMLRGLRRLRELRLPGNRLAAFPWAALRDAPKLRLLDLQANRLSAVPAEAARFLENLTFLDLSSNQLMRLPQELIVSWAHLETGIFPPGHHPRRVLGLQDNPWACDCRLYDLVHLLDGWAPNLAFIETELRCASPRSLAGVAFSQLELRKCQGPELHPGVASIRSLLGGTALLRCGATGVPGPEMSWRRANGRPLNGTVHQEVSSDGTSWTLLGLPAVSHLDSGDYICQAKNFLGASETVISLIVTEPPTSTEHSGSPGALWARTGGGGEAAAYNNKLVARHVPQIPKPAVLATGPSVPSTKEELTLEHFQMDALGELSDGRAGPSEARMVRSVKVVGDTYHSVSLVWKAPQAKNTTAFSVLYAVFGQHSMRRVIVQPGKTRVTITGLLPKTKYVACVCVQGLVPRKEQCVIFSTNEVVDAENTQQ

SEQ ID NO: 2668 - protein, 465 aa, synthetic construct
  REGION 1..465: note = LRIT2 (A6NDA9) SP+PP+ECD
MASVFHYFLLVLVFLDTHAAQPFCLPGCTCSEESFGRTLQCTSVSLGKIPGNLSEEFKQVRIENSPLFEMPQGSFINMSTLEYLWLNFNNISVIHLGALEHLPELRELRLEGNKLCSVPWTAFRATPLLRVLDLKRNKIDALPELALQFLVSLTYLDLSSNRLTVVSKSVFLNWPAYQKCRQPDCGAEILSSLVVALHDNPWVCDCRLRGLVQFVKSITLPVILVNSYLICQGPLSKAGQLFHETELSACMKPQISTPSANITIRAGQNVTLRCLAQASPSPSIAWTYPLSMWREFDVLTSSTGEDTALSELAIPAAHLVDSGNYTCMASNSIGKSNLVISLHVQPAQALHAPDSLSIPSEGNAYIDLRVVKQTVHGILLEWLAVADTSKEEWFTLYIASDEAFRKEVVHIGPGINTYAVDDLLPGTKYEACLSLEGQPPHQGQCVAFVTGRDAGGLEAREHLLH

SEQ ID NO: 2669 - protein, 582 aa, synthetic construct
  REGION 1..582: note = LRIT3 (Q3SXY7) SP+PP+ECD
MHLFACLCIVLSFLEGVGCLCPSQCTCDYHGRNDGSGSRLVLCNDMDMNELPTNLPVDTVKLRIEKTVIRRISAEAFYYLVELQYLWVTYNSVASIDPSSFYNLKQLHELRLDGNSLAAFPWASLLDMPLLRTLDLHNNKITSVPNEALRYLKNLAYLDLSSNRLTTLPPDFLESWTHLVSTPSGVLDLSPSRIILGLQDNPWFCDCHISKMIELSKVVDPAIVLLDPLMTCSEPERLTGILFQRAELEHCLKPSVMTSATKIMSALGSNVLLRCDATGFPTPQITWTRSDSSPVNYTVIQESPEEGVRWSIMSLTGISSKDAGDYKCKAKNLAGMSEAVVTVTVLGITTTPIPPDTSERTGDHPEWDVQPGSGRSTSVSSASSYLWSSSFSPTSSFSASTLSPPSTASFSLSPFSSSTVSSTTTLSTSISASTTMANKRSFQLHQGGKRNLKVAKNGSKLPPASTSKKEELALLDQTMLTETNAAIENLRVVSETKESVTLTWNMINTTHNSAVTVLYSKYGGKDLLLLNADSSKNQVTIDGLEPGGQYMACVCPKGVPPQKDQCITFSTERVEGDDSQWS

SEQ ID NO: 2670 - protein, 4419 aa, synthetic construct
  REGION 1..4419: note = LRP1 (Q07954) SP+PP+ECD
MLTPPLLLLLPLLSALVAAAIDAPKTCSPKQFACRDQITCISKGWRCDGERDCPDGSDEAPEICPQSKAQRCQPNEHNCLGTELCVPMSRLCNGVQDCMDGSDEGPHCRELQGNCSRLGCQHHCVPTLDGPTCYCNSSFQLQADGKTCKDFDECSVYGTCSQLCTNTDGSFICGCVEGYLLQPDNRSCKAKNEPVDRPPVLLIANSQNILATYLSGAQVSTITPTSTRQTTAMDFSYANETVCWVHVGDSAAQTQLKCARMPGLKGFVDEHTINISLSLHHVEQMAIDWLTGNFYFVDDIDDRIFVCNRNGDTCVTLLDLELYNPKGIALDPAMGKVFFTDYGQIPKVERCDMDGQNRTKLVDSKIVFPHGITLDLVSRLVYWADAYLDYIEVVDYEGKGRQTIIQGILIEHLYGLTVFENYLYATNSDNANAQQKTSVIRVNRFNSTEYQVVTRVDKGGALHIYHQRRQPRVRSHACENDQYGKPGGCSDICLLANSHKARTCRCRSGFSLGSDGKSCKKPEHELFLVYGKGRPGIIRGMDMGAKVPDEHMIPIENLMNPRALDFHAETGFIYFADTTSYLIGRQKIDGTERETILKDGIHNVEGVAVDWMGDNLYWTDDGPKKTISVARLEKAAQTRKTLIEGKMTHPRAIVVDPLNGWMYWTDWEEDPKDSRRGRLERAWMDGSHRDIFVTSKTVLWPNGLSLDIPAGRLYWVDAFYDRIETILLNGTDRKIVYEGPELNHAFGLCHHGNYLFWTEYRSGSVYRLERGVGGAPPTVTLLRSERPPIFEIRMYDAQQQQVGTNKCRVNNGGCSSLCLATPGSRQCACAEDQVLDADGVTCLANPSYVPPPQCQPGEFACANSRCIQERWKCDGDNDCLDNSDEAPALCHQHTCPSDRFKCENNRCIPNRWLCDGDNDCGNSEDESNATCSARTCPPNQFSCASGRCIPISWTCDLDDDCGDRSDESASCAYPTCFPLTQFTCNNGRCININWRCDNDNDCGDNSDEAGCSHSCSSTQFKCNSGRCIPEHWTCDGDNDCGDYSDETHANCTNQATRPPGGCHTDEFQCRLDGLCIPLRWRCDGDTDCMDSSDEKSCEGVTHVCDPSVKFGCKDSARCISKAWVCDGDNDCEDNSDEENCESLACRPPSHPCANNTSVCLPPDKLCDGNDDCGDGSDEGELCDQCSLNNGGCSHNCSVAPGEGIVCSCPLGMELGPDNHTCQIQSYCAKHLKCSQKCDQNKFSVKCSCYEGWVLEPDGESCRSLDPFKPFIIFSNRHEIRRIDLHKGDYSVLVPGLRNTIALDFHLSQSALYWTDVVEDKIYRGKLLDNGALTSFEVVIQYGLATPEGLAVDWIAGNIYWVESNLDQIEVAKLDGTLRTTLLAGDIEHPRAIALDPRDGILFWTDWDASLPRIEAASMSGAGRRTVHRETGSGGWPNGLTVDYLEKRILWIDARSDAIYSARYDGSGHMEVLRGHEFLSHPFAVTLYGGEVYWTDWRTNTLAKANKWTGHNVTVVQRTNTQPFDLQVYHPSRQPMAPNPCEANGGQGPCSHLCLINYNRTVSCACPHLMKLHKDNTTCYEFKKFLLYARQMEIRGVDLDAPYYNYIISFTVPDIDNVTVLDYDAREQRVYWSDVRTQAIKRAFINGTGVETVVSADLPNAHGLAVDWVSRNLFWTSYDTNKKQINVARLDGSFKNAVVQGLEQPHGLVVHPLRGKLYWTDGDNISMANMDGSNRTLLFSGQKGPVGLAIDFPESKLYWISSGNHTINRCNLDGSGLEVIDAMRSQLGKATALAIMGDKLWWADQVSEKMGTCSKADGSGSVVLRNSTTLVMHMKVYDESIQLDHKGTNPCSVNNGDCSQLCLPTSETTRSCMCTAGYSLRSGQQACEGVGSFLLYSVHEGIRGIPLDPNDKSDALVPVSGTSLAVGIDFHAENDTIYWVDMGLSTISRAKRDQTWREDVVTNGIGRVEGIAVDWIAGNIYWTDQGFDVIEVARLNGSFRYVVISQGLDKPRAITVHPEKGYLFWTEWGQYPRIERSRLDGTERVVLVNVSISWPNGISVDYQDGKLYWCDARTDKIERIDLETGENREVVLSSNNMDMFSVSVFEDFIYWSDRTHANGSIKRGSKDNATDSVPLRTGIGVQLKDIKVFNRDRQKGTNVCAVANGGCQQLCLYRGRGQRACACAHGMLAEDGASCREYAGYLLYSERTILKSIHLSDERNLNAPVQPFEDPEHMKNVIALAFDYRAGTSPGTPNRIFFSDIHFGNIQQINDDGSRRITIVENVGSVEGLAYHRGWDTLYWTSYTTSTITRHTVDQTRPGAFERETVITMSGDDHPRAFVLDECQNLMFWTNWNEQHPSIMRAALSGANVLTLIEKDIRTPNGLAIDHRAEKLYFSDATLDKIERCEYDGSHRYVILKSEPVHPFGLAVYGEHIFWTDWVRRAVQRANKHVGSNMKLLRVDIPQQPMGIIAVANDTNSCELSPCRINNGGCQDLCLLTHQGHVNCSCRGGRILQDDLTCRAVNSSCRAQDEFECANGECINFSLTCDGVPHCKDKSDEKPSYCNSRRCKKTFRQCSNGRCVSNMLWCNGADDCGDGSDEIPCNKTACGVGEFRCRDGTCIGNSSRCNQFVDCEDASDEMNCSATDCSSYFRLGVKGVLFQPCERTSLCYAPSWVCDGANDCGDYSDERDCPGVKRPRCPLNYFACPSGRCIPMSWTCDKEDDCEHGEDETHCNKFCSEAQFECQNHRCISKQWLCDGSDDCGDGSDEAAHCEGKTCGPSSFSCPGTHVCVPERWLCDGDKDCADGADESIAAGCLYNSTCDDREFMCQNRQCIPKHFVCDHDRDCADGSDESPECEYPTCGPSEFRCANGRCLSSRQWECDGENDCHDQSDEAPKNPHCTSQEHKCNASSQFLCSSGRCVAEALLCNGQDDCGDSSDERGCHINECLSRKLSGCSQDCEDLKIGFKCRCRPGFRLKDDGRTCADVDECSTTFPCSQRCINTHGSYKCLCVEGYAPRGGDPHSCKAVTDEEPFLIFANRYYLRKLNLDGSNYTLLKQGLNNAVALDFDYREQMIYWTDVTTQGSMIRRMHLNGSNVQVLHRTGLSNPDGLAVDWVGGNLYWCDKGRDTIEVSKLNGAYRTVLVSSGLREPRALVVDVQNGYLYWTDWGDHSLIGRIGMDGSSRSVIVDTKITWPNGLTLDYVTERIYWADAREDYIEFASLDGSNRHVVLSQDIPHIFALTLFEDYVYWTDWETKSINRAHKTTGTNKTLLISTLHRPMDLHVFHALRQPDVPNHPCKVNNGGCSNLCLLSPGGGHKCACPTNFYLGSDGRTCVSNCTASQFVCKNDKCIPFWWKCDTEDDCGDHSDEPPDCPEFKCRPGQFQCSTGICTNPAFICDGDNDCQDNSDEANCDIHVCLPSQFKCTNTNRCIPGIFRCNGQDNCGDGEDERDCPEVTCAPNQFQCSITKRCIPRVWVCDRDNDCVDGSDEPANCTQMTCGVDEFRCKDSGRCIPARWKCDGEDDCGDGSDEPKEECDERTCEPYQFRCKNNRCVPGRWQCDYDNDCGDNSDEESCTPRPCSESEFSCANGRCIAGRWKCDGDHDCADGSDEKDCTPRCDMDQFQCKSGHCIPLRWRCDADADCMDGSDEEACGTGVRTCPLDEFQCNNTLCKPLAWKCDGEDDCGDNSDENPEECARFVCPPNRPFRCKNDRVCLWIGRQCDGTDNCGDGTDEEDCEPPTAHTTHCKDKKEFLCRNQRCLSSSLRCNMFDDCGDGSDEEDCSIDPKLTSCATNASICGDEARCVRTEKAAYCACRSGFHTVPGQPGCQDINECLRFGTCSQLCNNTKGGHLCSCARNFMKTHNTCKAEGSEYQVLYIADDNEIRSLFPGHPHSAYEQAFQGDESVRIDAMDVHVKAGRVYWTNWHTGTISYRSLPPAAPPTTSNRHRRQIDRGVTHLNISGLKMPRGIAIDWVAGNVYWTDSGRDVIEVAQMKGENRKTLISGMIDEPHAIVVDPLRGTMYWSDWGNHPKIETAAMDGTLRETLVQDNIQWPTGLAVDYHNERLYWADAKLSVIGSIRLNGTDPIVAADSKRGLSHPFSIDVFEDYIYGVTYINNRVFKIHKFGHSPLVNLTGGLSHASDVVLYHQHKQPEVTNPCDRKKCEWLCLLSPSGPVCTCPNGKRLDNGTCVPVPSPTPPPDAPRPGTCNLQCFNGGSCFLNARRQPKCRCQPRYTGDKCELDQCWEHCRNGGTCAASPSGMPTCRCPTGFTGPKCTQQVCAGYCANNSTCTVNQGNQPQCRCLPGFLGDRCQYRQCSGYCENFGTCQMAADGSRQCRCTAYFEGSRCEVNKCSRCLEGACVVNKQSGDVTCNCTDGRVAPSCLTCVGHCSNGGSCTMNSKMMPECQCPPHMTGPRCEEHVFSQQQPG

SEQ ID NO: 2671 - protein, 440 aa, synthetic construct
  REGION 1..440: note = LRP10 (Q7Z4F1) SP+PP+ECD
MLLATLLLLLLGGALAHPDRIIFPNHACEDPPAVLLEVQGTLQRPLVRDSRTSPANCTWLILGSKEQTVTIRFQKLHLACGSERLTLRSPLQPLISLCEAPPSPLQLPGGNVTITYSYAGARAPMGQGFLLSYSQDWLMCLQEEFQCLNHRCVSAVQRCDGVDACGDGSDEAGCSSDPFPGLTPRPVPSLPCNVTLEDFYGVFSSPGYTHLASVSHPQSCHWLLDPHDGRRLAVRFTALDLGFGDAVHVYDGPGPPESSRLLRSLTHFSNGKAVTVETLSGQAVVSYHTVAWSNGRGFNATYHVRGYCLPWDRPCGLGSGLGAGEGLGERCYSEAQRCDGSWDCADGTDEEDCPGCPPGHFPCGAAGTSGATACYLPADRCNYQTFCADGADERRCRHCQPGNFRCRDEKCVYETWVCDGQPDCADGSDEWDCSYVLPRK

SEQ ID NO: 2672 - protein, 450 aa, synthetic construct
  REGION 1..450: note = LRP11 (Q86VZ4) SP+PP+ECD
MASVAQESAGSQRRLPPRHGALRGLLLLCLWLPSGRAALPPAAPLSELHAQLSGVEQLLEEFRRQLQQERPQEELELELRAGGGPQEDCPGPGSGGYSAMPDAIIRTKDSLAAGASFLRAPAAVRGWRQCVAACCSEPRCSVAVVELPRRPAPPAAVLGCYLFNCTARGRNVCKFALHSGYSSYSLSRAPDGAALATARASPRQEKDAPPLSKAGQDVVLHLPTDGVVLDGRESTDDHAIVQYEWALLQGDPSVDMKVPQSGTLKLSHLQEGTYTFQLTVTDTAGQRSSDNVSVTVLRAAYSTGGCLHTCSRYHFFCDDGCCIDITLACDGVQQCPDGSDEDFCQNLGLDRKMVTHTAASPALPRTTGPSEDAGGDSLVEKSQKATAPNKPPALSNTEKRNHSAFWGPESQIIPVMPDSSSSGKNRKEESYIFESKGDGGGGEHPAPETG

SEQ ID NO: 2673 - protein, 492 aa, synthetic construct
  REGION 1..492: note = LRP12 (Q9Y561) SP+PP+ECD
MACRWSTKESPRWRSALLLLFLAGVYGNGALAEHSENVHISGVSTACGETPEQIRAPSGIITSPGWPSEYPAKINCSWFIRANPGEIITISFQDFDIQGSRRCNLDWLTIETYKNIESYRACGSTIPPPYISSQDHIWIRFHSDDNISRKGFRLAYFSGKSEEPNCACDQFRCGNGKCIPEAWKCNNMDECGDSSDEEICAKEANPPTAAAFQPCAYNQFQCLSRFTKVYTCLPESLKCDGNIDCLDLGDEIDCDVPTCGQWLKYFYGTFNSPNYPDFYPPGSNCTWLIDTGDHRKVILRFTDFKLDGTGYGDYVKIYDGLEENPHKLLRVLTAFDSHAPLTVVSSSGQIRVHFCADKVNAARGFNATYQVDGFCLPWEIPCGGNWGCYTEQQRCDGYWHCPNGRDETNCTMCQKEEFPCSRNGVCYPRSDRCNYQNHCPNGSDEKNCFFCQPGNFHCKNNRCVFESWVCDSQDDCGDGSDEENCPVIVPTR

SEQ ID NO: 2674 - protein, 4440 aa, synthetic construct
  REGION 1..4440: note = LRP1B (Q9NZR2) SP+PP+ECD
MSEFLLALLTLSGLLPIARVADRDQQLCDPGEFLCHDHVTCVSQSWLCDGDPDCPDDSDESLDTCPEEVEIKCPLNHIACLGTNKCVHLSQLCNGVLDCPDGYDEGVHCQELLSNCQQLNCQYKCTMVRNSTRCYCEDGFEITEDGRSCKDQDECAVYGTCSQTCRNTHGSYTCSCVEGYLMQPDNRSCKAKIEPTDRPPILLIANFETIEVFYLNGSKMATLSSVNGNEIHTLDFIYNEDMICWIESRESSNQLKCIQITKAGGLTDEWTINILQSFHNVQQMAIDWLTRNLYFVDHVGDRIFVCNSNGSVCVTLIDLELHNPKAIAVDPIAGKLFFTDYGNVAKVERCDMDGMNRTRIIDSKTEQPAALALDLVNKLVYWVDLYLDYVGVVDYQGKNRHTVIQGRQVRHLYGITVFEDYLYATNSDNYNIVRINRFNGTDIHSLIKIENAWGIRIYQKRTQPTVRSHACEVDPYGMPGGCSHICLLSSSYKTRTCRCRTGFNLGSDGRSCKRPKNELFLFYGKGRPGIVRGMDLNTKIADEYMIPIENLVNPRALDFHAETNYIYFADTTSFLIGRQKIDGTERETILKDDLDNVEGIAVDWIGNNLYWTNDGHRKTINVARLEKASQSRKTLLEGEMSHPRGIVVDPVNGWMYWTDWEEDEIDDSVGRIEKAWMDGFNRQIFVTSKMLWPNGLTLDFHTNTLYWCDAYYDHIEKVFLNGTHRKIVYSGRELNHPFGLSHHGNYVFWTDYMNGSIFQLDLITSEVTLLRHERPPLFGLQIYDPRKQQGDNMCRVNNGGCSTLCLAIPGGRVCACADNQLLDENGTTCTFNPGEALPHICKAGEFRCKNRHCIQARWKCDGDDDCLDGSDEDSVNCFNHSCPDDQFKCQNNRCIPKRWLCDGANDCGSNEDESNQTCTARTCQVDQFSCGNGRCIPRAWLCDREDDCGDQTDEMASCEFPTCEPLTQFVCKSGRCISSKWHCDSDDDCGDGSDEVGCVHSCFDNQFRCSSGRCIPGHWACDGDNDCGDFSDEAQINCTKEEIHSPAGCNGNEFQCHPDGNCVPDLWRCDGEKDCEDGSDEKGCNGTIRLCDHKTKFSCWSTGRCINKAWVCDGDIDCEDQSDEDDCDSFLCGPPKHPCANDTSVCLQPEKLCNGKKDCPDGSDEGYLCDECSLNNGGCSNHCSVVPGRGIVCSCPEGLQLNKDNKTCEIVDYCSNHLKCSQVCEQHKHTVKCSCYEGWKLDVDGESCTSVDPFEAFIIFSIRHEIRRIDLHKRDYSLLVPGLRNTIALDFHFNQSLLYWTDVVEDRIYRGKLSESGGVSAIEVVVEHGLATPEGLTVDWIAGNIYWIDSNLDQIEVAKLDGSLRTTLIAGAMEHPRAIALDPRYGILFWTDWDANFPRIESASMSGAGRKTIYKDMKTGAWPNGLTVDHFEKRIVWTDARSDAIYSALYDGTNMIEIIRGHEYLSHPFAVSLYGSEVYWTDWRTNTLSKANKWTGQNVSVIQKTSAQPFDLQIYHPSRQPQAPNPCAANDGKGPCSHMCLINHNRSAACACPHLMKLSSDKKTCYEMKKFLLYARRSEIRGVDIDNPYFNFITAFTVPDIDDVTVIDFDASEERLYWTDIKTQTIKRAFINGTGLETVISRDIQSIRGLAVDWVSRNLYWISSEFDETQINVARLDGSLKTSIIHGIDKPQCLAAHPVRGKLYWTDGNTINMANMDGSNSKILFQNQKEPVGLSIDYVENKLYWISSGNGTINRCNLDGGNLEVIESMKEELTKATALTIMDKKLWWADQNLAQLGTCSKRDGRNPTILRNKTSGVVHMKVYDKEAQQGSNSCQLNNGGCSQLCLPTSETTRTCMCTVGYYLQKNRMSCQGIESFLMYSVHEGIRGIPLEPSDKMDALMPISGTSFAVGIDFHAENDTIYWTDMGFNKISRAKRDQTWKEDIITNGLGRVEGIAVDWIAGNIYWTDHGFNLIEVARLNGSFRYVIISQGLDQPRSIAVHPEKGLLFWTEWGQMPCIGKARLDGSEKVVLVSMGIAWPNGISIDYEENKLYWCDARTDKIERIDLETGGNREMVLSGSNVDMFSVAVFGAYIYWSDRAHANGSVRRGHKNDATETITMRTGLGVNLKEVKIFNRVREKGTNVCARDNGGCKQLCLYRGNSRRTCACAHGYLAEDGVTCLRHEGYLLYSGRTILKSIHLSDETNLNSPIRPYENPRYFKNVIALAFDYNQRRKGTNRIFYSDAHFGNIQLIKDNWEDRQVIVENVGSVEGLAYHRAWDTLYWTSSTTSSITRHTVDQTRPGAFDREAVITMSEDDHPHVLALDECQNLMFWTNWNEQHPSIMRSTLTGKNAQVVVSTDILTPNGLTIDYRAEKLYFSDGSLGKIERCEYDGSQRHVIVKSGPGTFLSLAVYDNYIFWSDWGRRAILRSNKYTGGDTKILRSDIPHQPMGIIAVANDTNSCELSPCALLNGGCHDLCLLTPNGRVNCSCRGDRILLEDNRCVTKNSSCNAYSEFECGNGECIDYQLTCDGIPHCKDKSDEKLLYCENRSCRRGFKPCYNRRCIPHGKLCDGENDCGDNSDELDCKVSTCATVEFRCADGTCIPRSARCNQNIDCADASDEKNCNNTDCTHFYKLGVKTTGFIRCNSTSLCVLPTWICDGSNDCGDYSDELKCPVQNKHKCEENYFSCPSGRCILNTWICDGQKDCEDGRDEFHCDSSCSWNQFACSAQKCISKHWICDGEDDCGDGLDESDSICGAITCAADMFSCQGSRACVPRHWLCDGERDCPDGSDELSTAGCAPNNTCDENAFMCHNKVCIPKQFVCDHDDDCGDGSDESPQCGYRQCGTEEFSCADGRCLLNTQWQCDGDFDCPDHSDEAPLNPKCKSAEQSCNSSFFMCKNGRCIPSGGLCDNKDDCGDGSDERNCHINECLSKKVSGCSQDCQDLPVSYKCKCWPGFQLKDDGKTCVDIDECSSGFPCSQQCINTYGTYKCLCTDGYEIQPDNPNGCKSLSDEEPFLILADHHEIRKISTDGSNYTLLKQGLNNVIAIDFDYREEFIYWIDSSRPNGSRINRMCLNGSDIKVVHNTAVPNALAVDWIGKNLYWSDTEKRIIEVSKLNGLYPTILVSKRLKFPRDLSLDPQAGYLYWIDCCEYPHIGRVGMDGTNQSVVIETKISRPMALTIDYVNRRLYWADENHIEFSNMDGSHRHKVPNQDIPGVIALTLFEDYIYWTDGKTKSLSRAHKTSGADRLSLIYSWHAITDIQVYHSYRQPDVSKHLCMINNGGCSHLCLLAPGKTHTCACPTNFYLAADNRTCLSNCTASQFRCKTDKCIPFWWKCDTVDDCGDGSDEPDDCPEFRCQPGRFQCGTGLCALPAFICDGENDCGDNSDELNCDTHVCLSGQFKCTKNQKCIPVNLRCNGQDDCGDEEDERDCPENSCSPDYFQCKTTKHCISKLWVCDEDPDCADASDEANCDKKTCGPHEFQCKNNNCIPDHWRCDSQNDCSDNSDEENCKPQTCTLKDFLCANGDCVSSRFWCDGDFDCADGSDERNCETSCSKDQFRCSNGQCIPAKWKCDGHEDCKYGEDEKSCEPASPTCSSREYICASDGCISASLKCNGEYDCADGSDEMDCVTECKEDQFRCKNKAHCIPIRWLCDGIHDCVDGSDEENCERGGNICRADEFLCNNSLCKLHFWVCDGEDDCGDNSDEAPDMCVKFLCPSTRPHRCRNNRICLQSEQMCNGIDECGDNSDEDHCGGKLTYKARPCKKDEFACSNKKCIPMDLQCDRLDDCGDGSDEQGCRIAPTEYTCEDNVNPCGDDAYCNQIKTSVFCRCKPGFQRNMKNRQCEDLNECLVFGTCSHQCINVEGSYKCVCDQNFQERNNTCIAEGSEDQVLYIANDTDILGFIYPFNYSGDHQQISHIEHNSRITGMDVYYQRDMIIWSTQFNPGGIFYKRIHGREKRQANSGLICPEFKRPRDIAVDWVAGNIYWTDHSRMHWFSYYTTHWTSLRYSINVGQLNGPNCTRLLTNMAGEPYAIAVNPKRGMMYWTVVGDHSHIEEAAMDGTLRRILVQKNLQRPTGLAVDYFSERIYWADFELSIIGSVLYDGSNSVVSVSSKQGLLHPHRIDIFEDYIYGAGPKNGVFRVQKFGHGSVEYLALNIDKTKGVLISHRYKQLDLPNPCLDLACEFLCLLNPSGATCVCPEGKYLINGTCNDDSLLDDSCKLTCENGGRCILNEKGDLRCHCWPSYSGERCEVNHCSNYCQNGGTCVPSVLGRPTCSCALGFTGPNCGKTVCEDFCQNGGTCIVTAGNQPYCHCQPEYTGDRCQYYVCHHYCVNSESCTIGDDGSVECVCPTRYEGPKCEVDKCVRCHGGHCIINKDSEDIFCNCTNGKIASSCQLCDGYCYNGGTCQLDPETNVPVCLCSTNWSGTQCERPAPKSSKSDHISTRSI

SEQ ID NO: 2675 - protein, 4423 aa, synthetic construct
  REGION 1..4423: note = LRP2 (P98164) SP+PP+ECD
MDRGPAAVACTLLLALVACLAPASGQECDSAHFRCGSGHCIPADWRCDGTKDCSDDADEIGCAVVTCQQGYFKCQSEGQCIPNSWVCDQDQDCDDGSDERQDCSQSTCSSHQITCSNGQCIPSEYRCDHVRDCPDGADENDCQYPTCEQLTCDNGACYNTSQKCDWKVDCRDSSDEINCTEICLHNEFSCGNGECIPRAYVCDHDNDCQDGSDEHACNYPTCGGYQFTCPSGRCIYQNWVCDGEDDCKDNGDEDGCESGPHDVHKCSPREWSCPESGRCISIYKVCDGILDCPGREDENNTSTGKYCSMTLCSALNCQYQCHETPYGGACFCPPGYIINHNDSRTCVEFDDCQIWGICDQKCESRPGRHLCHCEEGYILERGQYCKANDSFGEASIIFSNGRDLLIGDIHGRSFRILVESQNRGVAVGVAFHYHLQRVFWTDTVQNKVFSVDINGLNIQEVLNVSVETPENLAVDWVNNKIYLVETKVNRIDMVNLDGSYRVTLITENLGHPRGIAVDPTVGYLFFSDWESLSGEPKLERAFMDGSNRKDLVKTKLGWPAGVTLDMISKRVYWVDSRFDYIETVTYDGIQRKTVVHGGSLIPHPFGVSLFEGQVFFTDWTKMAVLKANKFTETNPQVYYQASLRPYGVTVYHSLRQPYATNPCKDNNGGCEQVCVLSHRTDNDGLGFRCKCTFGFQLDTDERHCIAVQNFLIFSSQVAIRGIPFTLSTQEDVMVPVSGNPSFFVGIDFDAQDSTIFFSDMSKHMIFKQKIDGTGREILAANRVENVESLAFDWISKNLYWTDSHYKSISVMRLADKTRRTVVQYLNNPRSVVVHPFAGYLFFTDWFRPAKIMRAWSDGSHLLPVINTTLGWPNGLAIDWAASRLYWVDAYFDKIEHSTFDGLDRRRLGHIEQMTHPFGLAIFGEHLFFTDWRLGAIIRVRKADGGEMTVIRSGIAYILHLKSYDVNIQTGSNACNQPTHPNGDCSHFCFPVPNFQRVCGCPYGMRLASNHLTCEGDPTNEPPTEQCGLFSFPCKNGRCVPNYYLCDGVDDCHDNSDEQLCGTLNNTCSSSAFTCGHGECIPAHWRCDKRNDCVDGSDEHNCPTHAPASCLDTQYTCDNHQCISKNWVCDTDNDCGDGSDEKNCNSTETCQPSQFNCPNHRCIDLSFVCDGDKDCVDGSDEVGCVLNCTASQFKCASGDKCIGVTNRCDGVFDCSDNSDEAGCPTRPPGMCHSDEFQCQEDGICIPNFWECDGHPDCLYGSDEHNACVPKTCPSSYFHCDNGNCIHRAWLCDRDNDCGDMSDEKDCPTQPFRCPSWQWQCLGHNICVNLSVVCDGIFDCPNGTDESPLCNGNSCSDFNGGCTHECVQEPFGAKCLCPLGFLLANDSKTCEDIDECDILGSCSQHCYNMRGSFRCSCDTGYMLESDGRTCKVTASESLLLLVASQNKIIADSVTSQVHNIYSLVENGSYIVAVDFDSISGRIFWSDATQGKTWSAFQNGTDRRVVFDSSIILTETIAIDWVGRNLYWTDYALETIEVSKIDGSHRTVLISKNLTNPRGLALDPRMNEHLLFWSDWGHHPRIERASMDGSMRTVIVQDKIFWPCGLTIDYPNRLLYFMDSYLDYMDFCDYNGHHRRQVIASDLIIRHPYALTLFEDSVYWTDRATRRVMRANKWHGGNQSVVMYNIQWPLGIVAVHPSKQPNSVNPCAFSRCSHLCLLSSQGPHFYSCVCPSGWSLSPDLLNCLRDDQPFLITVRQHIIFGISLNPEVKSNDAMVPIAGIQNGLDVEFDDAEQYIYWVENPGEIHRVKTDGTNRTVFASISMVGPSMNLALDWISRNLYSTNPRTQSIEVLTLHGDIRYRKTLIANDGTALGVGFPIGITVDPARGKLYWSDQGTDSGVPAKIASANMDGTSVKTLFTGNLEHLECVTLDIEEQKLYWAVTGRGVIERGNVDGTDRMILVHQLSHPWGIAVHDSFLYYTDEQYEVIERVDKATGANKIVLRDNVPNLRGLQVYHRRNAAESSNGCSNNMNACQQICLPVPGGLFSCACATGFKLNPDNRSCSPYNSFIVVSMLSAIRGFSLELSDHSETMVPVAGQGRNALHVDVDVSSGFIYWCDFSSSVASDNAIRRIKPDGSSLMNIVTHGIGENGVRGIAVDWVAGNLYFTNAFVSETLIEVLRINTTYRRVLLKVTVDMPRHIVVDPKNRYLFWADYGQRPKIERSFLDCTNRTVLVSEGIVTPRGLAVDRSDGYVYWVDDSLDIIARIRINGENSEVIRYGSRYPTPYGITVFENSIIWVDRNLKKIFQASKEPENTEPPTVIRDNINWLRDVTIFDKQVQPRSPAEVNNNPCLENNGGCSHLCFALPGLHTPKCDCAFGTLQSDGKNCAISTENFLIFALSNSLRSLHLDPENHSPPFQTINVERTVMSLDYDSVSDRIYFTQNLASGVGQISYATLSSGIHTPTVIASGIGTADGIAFDWITRRIYYSDYLNQMINSMAEDGSNRTVIARVPKPRAIVLDPCQGYLYWADWDTHAKIERATLGGNFRVPIVNSSLVMPSGLTLDYEEDLLYWVDASLQRIERSTLTGVDREVIVNAAVHAFGLTLYGQYIYWTDLYTQRIYRANKYDGSGQIAMTTNLLSQPRGINTVVKNQKQQCNNPCEQFNGGCSHICAPGPNGAECQCPHEGNWYLANNRKHCIVDNGERCGASSFTCSNGRCISEEWKCDNDNDCGDGSDEMESVCALHTCSPTAFTCANGRCVQYSYRCDYYNDCGDGSDEAGCLFRDCNATTEFMCNNRRCIPREFICNGVDNCHDNNTSDEKNCPDRTCQSGYTKCHNSNICIPRVYLCDGDNDCGDNSDENPTYCTTHTCSSSEFQCASGRCIPQHWYCDQETDCFDASDEPASCGHSERTCLADEFKCDGGRCIPSEWICDGDNDCGDMSDEDKRHQCQNQNCSDSEFLCVNDRPPDRRCIPQSWVCDGDVDCTDGYDENQNCTRRTCSENEFTCGYGLCIPKIFRCDRHNDCGDYSDERGCLYQTCQQNQFTCQNGRCISKTFVCDEDNDCGDGSDELMHLCHTPEPTCPPHEFKCDNGRCIEMMKLCNHLDDCLDNSDEKGCGINECHDPSISGCDHNCTDTLTSFYCSCRPGYKLMSDKRTCVDIDECTEMPFVCSQKCENVIGSYICKCAPGYLREPDGKTCRQNSNIEPYLIFSNRYYLRNLTIDGYFYSLILEGLDNVVALDFDRVEKRLYWIDTQRQVIERMFLNKTNKETIINHRLPAAESLAVDWVSRKLYWLDARLDGLFVSDLNGGHRRMLAQHCVDANNTFCFDNPRGLALHPQYGYLYWADWGHRAYIGRVGMDGTNKSVIISTKLEWPNGITIDYTNDLLYWADAHLGYIEYSDLEGHHRHTVYDGALPHPFAITIFEDTIYWTDWNTRTVEKGNKYDGSNRQTLVNTTHRPFDIHVYHPYRQPIVSNPCGTNNGGCSHLCLIKPGGKGFTCECPDDFRTLQLSGSTYCMPMCSSTQFLCANNEKCIPIWWKCDGQKDCSDGSDELALCPQRFCRLGQFQCSDGNCTSPQTLCNAHQNCPDGSDEDRLLCENHHCDSNEWQCANKRCIPESWQCDTFNDCEDNSDEDSSHCASRTCRPGQFRCANGRCIPQAWKCDVDNDCGDHSDEPIEECMSSAHLCDNFTEFSCKTNYRCIPKWAVCNGVDDCRDNSDEQGCEERTCHPVGDFRCKNHHCIPLRWQCDGQNDCGDNSDEENCAPRECTESEFRCVNQQCIPSRWICDHYNDCGDNSDERDCEMRTCHPEYFQCTSGHCVHSELKCDGSADCLDASDEADCPTRFPDGAYCQATMFECKNHVCIPPYWKCDGDDDCGDGSDEELHLCLDVPCNSPNRFRCDNNRCIYSHEVCNGVDDCGDGTDETEEHCRKPTPKPCTEYEYKCGNGHCIPHDNVCDDADDCGDWSDELGCNKGKERTCAENICEQNCTQLNEGGFICSCTAGFETNVFDRTSCLDINECEQFGTCPQHCRNTKGSYECVCADGFTSMSDRPGKRCAAEGSSPLLLLPDNVRIRKYNLSSERFSEYLQDEEYIQAVDYDWDPKDIGLSVVYYTVRGEGSRFGAIKRAYIPNFESGRNNLVQEVDLKLKYVMQPDGIAVDWVGRHIYWSDVKNKRIEVAKLDGRYRKWLISTDLDQPAAIAVNPKLGLMFWTDWGKEPKIESAWMNGEDRNILVFEDLGWPTGLSIDYLNNDRIYWSDFKEDVIETIKYDGTDRRVIAKEAMNPYSLDIFEDQLYWISKEKGEVWKQNKFGQGKKEKTLVVNPWLTQVRIFHQLRYNKSVPNLCKQICSHLCLLRPGGYSCACPQGSSFIEGSTTECDAAIELPINLPPPCRCMHGGNCYFDETDLPKCKCPSGYTGKYCEMAFSKGISPGTT

SEQ ID NO: 2676 - protein, 496 aa, synthetic construct
  REGION 1..496: note = LRP3 (O75074) SP+PP+ECD
MEKRAAAGLEGAPGARAQLAVVCLVNIFLTGRLSSAVPALAACSGKLEQHTERRGVIYSPAWPLNYPPGTNCSWYIQGDRGDMITISFRNFDVEESHQCSLDWLLLGPAAPPRQEAFRLCGSAIPPAFISARDHVWIFFHSDASSSGQAQGFRLSYIRGKLGQASCQADEFRCDNGKCLPGPWQCNTVDECGDGSDEGNCSAPASEPPGSLCPGGTFPCSGARSTRCLPVERRCDGLQDCGDGSDEAGCPDLACGRRLGSFYGSFASPDLFGAARGPSDLHCTWLVDTQDSRRVLLQLELRLGYDDYVQVYEGLGERGDRLLQTLSYRSNHRPVSLEAAQGRLTVAYHARARSAGHGFNATYQVKGYCLPWEQPCGSSSDSDGGSLGDQGCFSEPQRCDGWWHCASGRDEQGCPACPPDQYPCEGGSGLCYTPADRCNNQKSCPDGADEKNCFSCQPGTFHCGTNLCIFETWRCDGQEDCQDGSDEHGCLAAVPRK

SEQ ID NO: 2677 - protein, 1725 aa, synthetic construct
  REGION 1..1725: note = LRP4 (O75096) SP+PP+ECD
MRRQWGALLLGALLCAHGLASSPECACGRSHFTCAVSALGECTCIPAQWQCDGDNDCGDHSDEDGCILPTCSPLDFHCDNGKCIRRSWVCDGDNDCEDDSDEQDCPPRECEEDEFPCQNGYCIRSLWHCDGDNDCGDNSDEQCDMRKCSDKEFRCSDGSCIAEHWYCDGDTDCKDGSDEENCPSAVPAPPCNLEEFQCAYGRCILDIYHCDGDDDCGDWSDESDCSSHQPCRSGEFMCDSGLCINAGWRCDGDADCDDQSDERNCTTSMCTAEQFRCHSGRCVRLSWRCDGEDDCADNSDEENCENTGSPQCALDQFLCWNGRCIGQRKLCNGVNDCGDNSDESPQQNCRPRTGEENCNVNNGGCAQKCQMVRGAVQCTCHTGYRLTEDGHTCQDVNECAEEGYCSQGCTNSEGAFQCWCETGYELRPDRRSCKALGPEPVLLFANRIDIRQVLPHRSEYTLLLNNLENAIALDFHHRRELVFWSDVTLDRILRANLNGSNVEEVVSTGLESPGGLAVDWVHDKLYWTDSGTSRIEVANLDGAHRKVLLWQNLEKPRAIALHPMEGTIYWTDWGNTPRIEASSMDGSGRRIIADTHLFWPNGLTIDYAGRRMYWVDAKHHVIERANLDGSHRKAVISQGLPHPFAITVFEDSLYWTDWHTKSINSANKFTGKNQEIIRNKLHFPMDIHTLHPQRQPAGKNRCGDNNGGCTHLCLPSGQNYTCACPTGFRKISSHACAQSLDKFLLFARRMDIRRISFDTEDLSDDVIPLADVRSAVALDWDSRDDHVYWTDVSTDTISRAKWDGTGQEVVVDTSLESPAGLAIDWVTNKLYWTDAGTDRIEVANTDGSMRTVLIWENLDRPRDIVVEPMGGYMYWTDWGASPKIERAGMDASGRQVIISSNLTWPNGLAIDYGSQRLYWADAGMKTIEFAGLDGSKRKVLIGSQLPHPFGLTLYGERIYWTDWQTKSIQSADRLTGLDRETLQENLENLMDIHVFHRRRPPVSTPCAMENGGCSHLCLRSPNPSGFSCTCPTGINLLSDGKTCSPGMNSFLIFARRIDIRMVSLDIPYFADVVVPINITMKNTIAIGVDPQEGKVYWSDSTLHRISRANLDGSQHEDIITTGLQTTDGLAVDAIGRKVYWTDTGTNRIEVGNLDGSMRKVLVWQNLDSPRAIVLYHEMGFMYWTDWGENAKLERSGMDGSDRAVLINNNLGWPNGLTVDKASSQLLWADAHTERIEAADLNGANRHTLVSPVQHPYGLTLLDSYIYWTDWQTRSIHRADKGTGSNVILVRSNLPGLMDMQAVDRAQPLGFNKCGSRNGGCSHLCLPRPSGFSCACPTGIQLKGDGKTCDPSPETYLLFSSRGSIRRISLDTSDHTDVHVPVPELNNVISLDYDSVDGKVYYTDVFLDVIRRADLNGSNMETVIGRGLKTTDGLAVDWVARNLYWTDTGRNTIEASRLDGSCRKVLINNSLDEPRAIAVFPRKGYLFWTDWGHIAKIERANLDGSERKVLINTDLGWPNGLTLDYDTRRIYWVDAHLDRIESADLNGKLRQVLVSHVSHPFALTQQDRWIYWTDWQTKSIQRVDKYSGRNKETVLANVEGLMDIIVVSPQRQTGTNACGVNNGGCTHLCFARASDFVCACPDEPDSRPCSLVPGLVPPAPRATGMSEKSPVLPNTPPTTLYSSTTRTRTSLEEVEGRCSERDARLGLCARSNDAVPAAPGEGLHIS

SEQ ID NO: 2678 - protein, 1384 aa, synthetic construct
  REGION 1..1384: note = LRP5 (O75197) SP+PP+ECD
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPRAIALDPAHGYMYWTDWGETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGCSHLCLLSPSEPFYTCACPTGVQLQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKTISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERVVIADDLPHPFGLTQYSDYIYWTDWNLHSIERADKTSGRNRTLIQGHLDFVMDILVFHSSRQDGLNDCMHNNGQCGQLCLAIPGGHRCGCASHYTLDPSSRNCSPPTTFLLFSQKSAISRMIPDDQHSPDLILPLHGLRNVKAIDYDPLDKFIYWVDGRQNIKRAKDDGTQPFVLTSLSQGQNPDRQPHDLSIDIYSRTLFWTCEATNTINVHRLSGEAMGVVLRGDRDKPRAIVVNAERGYLYFTNMQDRAAKIERAALDGTEREVLFTTGLIRPVALVVDNTLGKLFWVDADLKRIESCDLSGANRLTLEDANIVQPLGLTILGKHLYWIDRQQQMIERVEKTTGDKRTRIQGRVAHLTGIHAVEEVSLEEFSAHPCARDNGGCSHICIAKGDGTPRCSCPVHLVLLQNLLTCGEPPTCSPDQFACATGEIDCIPGAWRCDGFPECDDQSDEEGCPVCSAAQFPCARGQCVDLRLRCDGEADCQDRSDEADCDAICLPNQFRCASGQCVLIKQQCDSFPDCIDGSDELMCEITKPPSDDSPAHS

SEQ ID NO: 2679 - protein, 1370 aa, synthetic construct
  REGION 1..1370: note = LRP6 (O75581) SP+PP+ECD
MGAVLRSLLACSFCVLLRAAPLLLYANRRDLRLVDATNGKENATIVVGGLEDAAAVDFVFSHGLIYWSDVSEEAIKRTEFNKTESVQNVVVSGLLSPDGLACDWLGEKLYWTDSETNRIEVSNLDGSLRKVLFWQELDQPRAIALDPSSGFMYWTDWGEVPKIERAGMDGSSRFIIINSEIYWPNGLTLDYEEQKLYWADAKLNFIHKSNLDGTNRQAVVKGSLPHPFALTLFEDILYWTDWSTHSILACNKYTGEGLREIHSDIFSPMDIHAFSQQRQPNATNPCGIDNGGCSHLCLMSPVKPFYQCACPTGVKLLENGKTCKDGATELLLLARRTDLRRISLDTPDFTDIVLQLEDIRHAIAIDYDPVEGYIYWTDDEVRAIRRSFIDGSGSQFVVTAQIAHPDGIAVDWVARNLYWTDTGTDRIEVTRLNGTMRKILISEDLEEPRAIVLDPMVGYMYWTDWGEIPKIERAALDGSDRVVLVNTSLGWPNGLALDYDEGKIYWGDAKTDKIEVMNTDGTGRRVLVEDKIPHIFGFTLLGDYVYWTDWQRRSIERVHKRSAEREVIIDQLPDLMGLKATNVHRVIGSNPCAEENGGCSHLCLYRPQGLRCACPIGFELISDMKTCIVPEAFLLFSRRADIRRISLETNNNNVAIPLTGVKEASALDFDVTDNRIYWTDISLKTISRAFMNGSALEHVVEFGLDYPEGMAVDWLGKNLYWADTGTNRIEVSKLDGQHRQVLVWKDLDSPRALALDPAEGFMYWTEWGGKPKIDRAAMDGSERTTLVPNVGRANGLTIDYAKRRLYWTDLDTNLIESSNMLGLNREVIADDLPHPFGLTQYQDYIYWTDWSRRSIERANKTSGQNRTIIQGHLDYVMDILVFHSSRQSGWNECASSNGHCSHLCLAVPVGGFVCGCPAHYSLNADNRTCSAPTTFLLFSQKSAINRMVIDEQQSPDIILPIHSLRNVRAIDYDPLDKQLYWIDSRQNMIRKAQEDGSQGFTVVVSSVPSQNLEIQPYDLSIDIYSRYIYWTCEATNVINVTRLDGRSVGVVLKGEQDRPRAVVVNPEKGYMYFTNLQERSPKIERAALDGTEREVLFFSGLSKPIALALDSRLGKLFWADSDLRRIESSDLSGANRIVLEDSNILQPVGLTVFENWLYWIDKQQQMIEKIDMTGREGRTKVQARIAQLSDIHAVKELNLQEYRQHPCAQDNGGCSHICLVKGDGTTRCSCPMHLVLLQDELSCGEPPTCSPQQFTCFTGEIDCIPVAWRCDGFTECEDHSDELNCPVCSESQFQCASGQCIDGALRCNGDANCQDKSDEKNCEVLCLIDQFRCANGQCIGKHKKCDHNVDCSDKSDELDCYPTEEPAPQA

SEQ ID NO: 2680 - protein, 817 aa, synthetic construct
  REGION 1..817: note = LRP8 (Q14114) SP+PP+ECD
MGLPEPGPLRLLALLLLLLLLLLLQLQHLAAAGPAKDCEKDQFQCRNERCIPSVWRCDEDDDCLDHSDEDDCPKKTCADSDFTCDNGHCIHERWKCDGEEECPDGSDESEATCTKQVCPAEKLSCGPTSHKCVPASWRCDGEKDCEGGADEAGCATLCAPHEFQCGNRSCLAAVFVCDGDDDCGDGSDERGCADPACGPREFRCGGDGGGACIPERWVCDRQFDCEDRSDEAAELCGRPGPGATSAPAACATASQFACRSGECVHLGWRCDGDRDCKDKSDEADCPLGTCRGDEFQCGDGTCVLAIKHCNQEQDCPDGSDEAGCLQGLNECLHNNGGCSHICTDLKIGFECTCPAGFQLLDQKTCGDIDECKDPDACSQICVNYKGYFKCECYPGYEMDLLTKNCKAAAGKSPSLIFTNRHEVRRIDLVKRNYSRLIPMLKNVVALDVEVATNRIYWCDLSYRKIYSAYMDKASDPKEQEVLIDEQLHSPEGLAVDWVHKHIYWTDSGNKTISVATVDGGRRRTLFSRNLSEPRAIAVDPLRGFMYWSDWGDQAKIEKSGLNGVDRQTLVSDNIEWPNGITLDLLSQRLYWVDSKLHQLSSIDFSGGNRKTLISSTDFLSHPFGIAVFEDKVFWTDLENEAIFSANRLNGLEISILAENLNNPHDIVIFHELKQPRAPDACELSVQPNGGCEYLCLPAPQISSHSPKYTCACPDTMWLGPDMKRCYRAPQSTSTTTLASTMTRTVPATTRAPGTTVHRSTYQNHSTETPSLTAAVPSSVSVPRAPSISPSTLSPATSNHSQHYANEDSKMGSTVTAA

SEQ ID NO: 2681 - protein, 538 aa, synthetic construct
  REGION 1..538: note = LRRC15 (Q8TF66) SP+PP+ECD
MPLKHYLLLLVGCQAWGAGLAYHGCPSECTCSRASQVECTGARIVAVPTPLPWNAMSLQILNTHITELNESPFLNISALIALRIEKNELSRITPGAFRNLGSLRYLSLANNKLQVLPIGLFQGLDSLESLLLSSNQLLQIQPAHFSQCSNLKELQLHGNHLEYIPDGAFDHLVGLTKLNLGKNSLTHISPRVFQHLGNLQVLRLYENRLTDIPMGTFDGLVNLQELALQQNQIGLLSPGLFHNNHNLQRLYLSNNHISQLPPSVFMQLPQLNRLTLFGNSLKELSPGIFGPMPNLRELWLYDNHISSLPDNVFSNLRQLQVLILSRNQISFISPGAFNGLTELRELSLHTNALQDLDGNVFRMLANLQNISLQNNRLRQLPGNIFANVNGLMAIQLQNNQLENLPLGIFDHLGKLCELRLYDNPWRCDSDILPLRNWLLLNQPRLGTDTVPVCFSPANVRGQSLIIINVNVAVPSVHVPEVPSYPETPWYPDTPSYPDTTSVSSTTELTSPVEDYTDLTTIQVTDDRSVWGMTQAQSG

SEQ ID NO: 2682 - protein, 270 aa, synthetic construct
  REGION 1..270: note = LRRC19 (Q9H756) SP+PP+ECD
MKVTGITILFWPLSMILLSDKIQSSKREVQCNFTEKNYTLIPADIKKDVTILDLSYNQITLNGTDTRVLQTYFLLTELYLIENKVTILHNNGFGNLSSLEILNICRNSIYVIQQGAFLGLNKLKQLYLCQNKIEQLNADVFVPLRSLKLLNLQGNLISYLDVPPLFHLELITLYGNLWNCSCSLFNLQNWLNTSNVTLENENITMCSYPNSLQSYNIKTVPHKAECHSKFPSSVTEDLYIHFQPISNSIFNSSSNNLTRNSEHEPLGKSW

SEQ ID NO: 2683 - protein, 405 aa, synthetic construct
  REGION 1..405: note = LRRC24 (Q50LG9) SP+PP+ECD
MALRAPALLPLLLLLLPLRAAGCPAACRCYSATVECGALRLRVVPLGIPPGTQTLFLQDNNIARLEPGALAPLAALRRLYLHNNSLRALEAGAFRAQPRLLELALTSNRLRGLRSGAFVGLAQLRVLYLAGNQLARLLDFTFLHLPRLQELHLQENSIELLEDQALAGLSSLALLDLSRNQLGTISREALQPLASLQVLRLTENPWRCDCALHWLGAWIKEGGQRLLTSRDRKIMCAEPPRLALQSLLDVSHSSLICIPPSVHVQPLELTANLGEDLRVACQASGYPQPLVTWRKVPQPREGRPRAQAQLEGGLLGLGGHSASDTGSGMLFLSNITLAHAGKYECEASNAGGAARVPFRLLVNASRQQPQQPAQPPPPAARPAGSEPRPEAGSMAFRALGVATQT

SEQ ID NO: 2684 - protein, 165 aa, synthetic construct
  REGION 1..165: note = LRRC25 (Q8N386) SP+PP+ECD
MGGTLAWTLLLPLLLRESDSLEPSCTVSSADVDWNAEFSATCLNFSGLSLSLPHNQSLRASNVILLDLSGNGLRELPVTFFAHLQKLEVLNVLRNPLSRVDGALAARCDLDLQADCNCALESWHDIRRDNCSGQKPLLCWDTTSSQHNLSAFLEVSCAPGLASAT

SEQ ID NO: 2685 - protein, 627 aa, synthetic construct
  REGION 1..627: note = LRRC32 (Q14392) SP+PP+ECD
MRPQILLLLALLTLGLAAQHQDKVPCKMVDKKVSCQVLGLLQVPSVLPPDTETLDLSGNQLRSILASPLGFYTALRHLDLSTNEISFLQPGAFQALTHLEHLSLAHNRLAMATALSAGGLGPLPRVTSLDLSGNSLYSGLLERLLGEAPSLHTLSLAENSLTRLTRHTFRDMPALEQLDLHSNVLMDIEDGAFEGLPRLTHLNLSRNSLTCISDFSLQQLRVLDLSCNSIEAFQTASQPQAEFQLTWLDLRENKLLHFPDLAALPRLIYLNLSNNLIRLPTGPPQDSKGIHAPSEGWSALPLSAPSGNASGRPLSQLLNLDLSYNEIELIPDSFLEHLTSLCFLNLSRNCLRTFEARRLGSLPCLMLLDLSHNALETLELGARALGSLRTLLLQGNALRDLPPYTFANLASLQRLNLQGNRVSPCGGPDEPGPSGCVAFSGITSLRSLSLVDNEIELLRAGAFLHTPLTELDLSSNPGLEVATGALGGLEASLEVLALQGNGLMVLQVDLPCFICLKRLNLAENRLSHLPAWTQAVSLEVLDLRNNSFSLLPGSAMGGLETSLRRLYLQGNPLSCCGNGWLAAQLHQGRVDVDATQDLICRFSSQEEVSLSHVRPEDCEKGGLKNIN

SEQ ID NO: 2686 - protein, 1582 aa, synthetic construct
  REGION 1..1582: note = LRRC37A (A6NMS7) SP+PP+ECD
MSSAQCPALVCVMSRLRFWGPWPLLMWQLLWLLVKEAQPLEWVKDPLQLTSNPLGPPESWSSHSSHFPRESPHAPTLPADPWDFDHLGPSASSEMPAPPQESTENLVPFLDTWDSAGEQPLEPEQFLASQQDLKDKLSPQERLPVSPKKLKKDPAQRWSLAEIIGITRQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVPPMEHELSISEQQQPVQPSESPREVESSPTQQETPGQPPEHHEVTVSPPGHHQTHHLASPSVSVKPPDVQLTIAAEPSAEVGTSLVHQEATTRLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESKTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETGHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLSYILPYFSAVNLDVKSLLLPFIKLPTTGNSLAKIQTVGQNRQRVKRVLMGPRSIQKRHFKEVGRQSIRREQGAQASVENAAEEKRLTSPAPREVEQPHTQQGPEKLAGNAVYTKPSFTQEHKAAVSVLKPFSKGTPSTSSPAKALPQVRDRSKDLTHAISILESAKARVTNTKTSKPIVHARKKYRFHKTRSHVTHRTTKVKKSPKVRKKSYLSRLMLANRLPFSAAKSLINSPSQGAFSSLGDLSPQENPFLEVSALSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKL

SEQ ID NO: 2687 - protein, 1582 aa, synthetic construct
  REGION 1..1582: note = LRRC37A2 (A6NM11) SP+PP+ECD
MSSAQCPALVCVMSRLRFWGPWPLLMWQLLWLLVKEAQPLEWVKDPLQLTSNPLGPPDSWSSHSSHFPRESPHAPTLPADPWDFDHLGPSASSEMPAPPQESTENLVPFLDTWDSAGEQPLEPEQFLASQQDLKDKLSPQERLPVSPKKLKKDPAQRWSLAEIIGITRQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVPPMEHELSISEQQQPVQPSESPREVESSPTQQETPGQPPEHHEVTVSPPGHHQTHHLASPSVSVKPPDVQLTIAAEPSAEVGTSLVHQEATTRLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESKTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETRHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLSYILPYFSAVNLDVKSLLLPFIKLPTTGNSLAKIQTVGQNRQRVKRVLMGPRSIQKRHFKEVGRQSIRREQGAQASVENAAEEKRLGSPAPREVEQPHTQQGPEKLAGNAVYTKPSFTQEHKAAVSVLKPFSKGAPSTSSPAKALPQVRDRWKDLTHAISILESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIENNNTKHTTARNAFEENDFMENTNMPEGTISENTNYNHPHEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKL

SEQ ID NO: 2688 - protein, 1581 aa, synthetic construct
  REGION 1..1581: note = LRRC37A3 (O60309) SP+PP+ECD
MTSAQCPALACVMSPLRFWGPWPLLMWQLLWLLVKEAQPLEWVKDPLQLTSNPLGPPEPWSSHSSHFPRESPHAPTLPADPWDFDHLGPSASSEMPAPPQESTENLVPFLDTWDSAGELPLEPEQFLASQQDLKDKLSPQERLPVSPKKLKKDPAQRWSLAEIIGIIHQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVPPMEHELSISEQQQPVQPSESSREVESSPTQQETPGQPPEHHEVTVSPPGHHQTHHLASPSVSVKPPDVQLTIAAEPSAEVGTSLVHQEATTRLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESMTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQLPDLGLAIIPEPTTETGHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLIVPSHMACCLCQFKNSIEAVCKTVKLHCNSACLTNTTHCPEEASVGNPEGAFMKVLQARKNYTSTELIIEPEEPSDSSGINLSGFGSEQLDTNDESDVTSTLSYILPYFSAVNLDVKSLLLPFIKLPTTGNSLAKIQTVGKNRQRLNRVLMGPRSIQKRHFKEVGRQSIRREQGAQASVENTAEEKRLGSPAPRELKQPHTQQGPEKLAGNAVYTKPSFTQEHKAAVSVLKPFSKGAPSTSSPAKALPQVRDRWKDLTHAISILESAKARVTNMKTSKPIVHSRKKYRFHKTRSRMTHRTPKVKKSPKVRKKSYLSRLMLSNRLPFSAAKSLINSPSQGAFSSLRDLSPQENPFLEVSAPSEHFIENNNTKDTTARNAFEENVFMENTNMPEGTISENTNYNHPPEADSAGTAFNLGPTVKQTETKWEYNNVGTDLSPEPKSFNYPLLSSPGDQFEIQLTQQLQSVIPNNNVRRLIAHVIRTLKMDCSGAHVQVTCAKLVSRTGHLMKLLSGQQEVKASKIEWDTDQWKTENYINESTEAQSEQKEKSLEFTKELPGYGYTKK

SEQ ID NO: 2689 - protein, 905 aa, synthetic construct
  REGION 1..905: note = LRRC37B (Q96QE4) SP+PP+ECD
MSWLRFWGPWPLLTWQLLSLLVKEAQPLVWVKDPLQLTSNPLGPPEPWSSRSSHLPWESPHAPAPPAAPGDFDYLGPSASSQMSALPQEPTENLAPFLKELDSAGELPLGPEPFLAAHQDLNDKRTPEERLPEVVPLLNRDQNQALVQLPRLKWVQTTDLDRAAGHQADEILVPLDSKVSRPTKFVVSPKNLKKDLAERWSLPEIVGIPHQLSKPQRQKQTLPDDYLSMDTLYPGSLPPELRVNADEPPGPPEQVGLSQFHLEPKSQNPETLEDIQSSSLQEEAPAQLLQLPQEVEPSTQQEAPALPPESSMESLAQTPLNHEVTVQPPGEDQAHYNLPKFTVKPADVEVTMTSEPKNETESTQAQQEAPIQPPEEAEPSSTALRTTDPPPEHPEVTLPPSDKGQAQHSHLTEATVQPLDLELSITTEPTTEVKPSPTTEETSAQPPDPGLAITPEPTTEIGHSTALEKTRAPHPDQVQTLHRSLTEVTGPPTKLESSQDSLVQSETAPEEQKASTSTNICELCTCGDETLSCVGLSPKQRLRQVPVPEPDTYNGIFTTLNFQGNYISYLDGNVWKAYSWTEKLILSENYLTELPKDSFEGLLYLQYLDLSCNKIRYIERQTFESLPFLQYINLGCNLITKLSLGTFQAWHGMQFLHNLILNRNPLTTVEDPYLFELPALKYLDMGTTHITLTTLKNILTMTVELEKLILPSHMACCLCQFKNSIEAVCKTVKLHCNTACLTNSIHCPEEASVGNPEGAFMKMLQARKQHMSTQLTIESEAPSDSSGINLSGFGGDQLEIQLTEQLRSLIPNEDVRKFMSHVIRTLKMECSETHVQGSCAKLMLRTGLLMKLLSEQQEAKALNVEWDTDQQKTNYINENMEQNEQKEQKSSELMKEVPGDDYKNK

SEQ ID NO: 2690 - protein, 249 aa, synthetic construct
  REGION 1..249: note = LRRC38 (Q5VT99) SP+PP+ECD
MRPRAPACAAAALGLCSLLLLLAPGHACPAGCACTDPHTVDCRDRGLPSVPDPFPLDVRKLLVAGNRIQRIPEDFFIFYGDLVYLDFRNNSLRSLEEGTFSGSAKLVFLDLSYNNLTQLGAGAFRSAGRLVKLSLANNNLVGVHEDAFETLESLQVLELNDNNLRSLSVAALAALPALRSLRLDGNPWLCDCDFAHLFSWIQENASKLPKGLDEIQCSLPMESRRISLRELSEASFSECRFSLSLTDLC

SEQ ID NO: 2691 - protein, 204 aa, synthetic construct
  REGION 1..204: note = LRRC3B (Q96PB8) SP+PP+ECD
MNLVDLWLTRSLSMCLLLQSFVLMILCFHSASMCPKGCLCSSSGGLNVTCSNANLKEIPRDLPPETVLLYLDSNQITSIPNEIFKDLHQLRVLNLSKNGIEFIDEHAFKGVAETLQTLDLSDNRIQSVHKNAFNNLKARARIANNPWHCDCTLQQVLRSMASNHETAHNVICKTSVLDEHAGRPFLNAANDADLCNLPKKTTDY

SEQ ID NO: 2692 - protein, 527 aa, synthetic construct
  REGION 1..527: note = LRRC4 (Q9HBW1) SP+PP+ECD
MKLLWQVTVHHHTWNAILLPFVYLTAQVWILCAAIAAAASAGPQNCPSVCSCSNQFSKVVCTRRGLSEVPQGIPSNTRYLNLMENNIQMIQADTFRHLHHLEVLQLGRNSIRQIEVGAFNGLASLNTLELFDNWLTVIPSGAFEYLSKLRELWLRNNPIESIPSYAFNRVPSLMRLDLGELKKLEYISEGAFEGLFNLKYLNLGMCNIKDMPNLTPLVGLEELEMSGNHFPEIRPGSFHGLSSLKKLWVMNSQVSLIERNAFDGLASLVELNLAHNNLSSLPHDLFTPLRYLVELHLHHNPWNCDCDILWLAWWLREYIPTNSTCCGRCHAPMHMRGRYLVEVDQASFQCSAPFIMDAPRDLNISEGRMAELKCRTPPMSSVKWLLPNGTVLSHASRHPRISVLNDGTLNFSHVLLSDTGVYTCMVTNVAGNSNASAYLNVSTAELNTSNYSFFTTVTVETTEISPEDTTRKYKPVPTTSTGYQPAYTTSTTVLIQTTRVPKQVAVPATDTTDKMQTSLDEVMKTTK

SEQ ID NO: 2693 - protein, 576 aa, synthetic construct
  REGION 1..576: note = LRRC4B (Q9NT99) SP+PP+ECD
MARARGSPCPPLPPGRMSWPHGALLFLWLFSPPLGAGGGGVAVTSAAGGGSPPATSCPVACSCSNQASRVICTRRDLAEVPASIPVNTRYLNLQENGIQVIRTDTFKHLRHLEILQLSKNLVRKIEVGAFNGLPSLNTLELFDNRLTTVPTQAFEYLSKLRELWLRNNPIESIPSYAFNRVPSLRRLDLGELKRLEYISEAAFEGLVNLRYLNLGMCNLKDIPNLTALVRLEELELSGNRLDLIRPGSFQGLTSLRKLWLMHAQVATIERNAFDDLKSLEELNLSHNNLMSLPHDLFTPLHRLERVHLNHNPWHCNCDVLWLSWWLKETVPSNTTCCARCHAPAGLKGRYIGELDQSHFTCYAPVIVEPPTDLNVTEGMAAELKCRTGTSMTSVNWLTPNGTLMTHGSYRVRISVLHDGTLNFTNVTVQDTGQYTCMVTNSAGNTTASATLNVSAVDPVAAGGTGSGGGGPGGSGGVGGGSGGYTYFTTVTVETLETQPGEEALQPRGTEKEPPGPTTDGVWGGGRPGDAAGPASSSTTAPAPRSSRPTEKAFTVPITDVTENALKDLDDVMKTTK

SEQ ID NO: 2694 - protein, 527 aa, synthetic construct
  REGION 1..527: note = LRRC4C (Q9HCJ2) SP+PP+ECD
MLNKMTLHPQQIMIGPRFNRALFDPLLVVLLALQLLVVAGLVRAQTCPSVCSCSNQFSKVICVRKNLREVPDGISTNTRLLNLHENQIQIIKVNSFKHLRHLEILQLSRNHIRTIEIGAFNGLANLNTLELFDNRLTTIPNGAFVYLSKLKELWLRNNPIESIPSYAFNRIPSLRRLDLGELKRLSYISEGAFEGLSNLRYLNLAMCNLREIPNLTPLIKLDELDLSGNHLSAIRPGSFQGLMHLQKLWMIQSQIQVIERNAFDNLQSLVEINLAHNNLTLLPHDLFTPLHHLERIHLHHNPWNCNCDILWLSWWIKDMAPSNTACCARCNTPPNLKGRYIGELDQNYFTCYAPVIVEPPADLNVTEGMAAELKCRASTSLTSVSWITPNGTVMTHGAYKVRIAVLSDGTLNFTNVTVQDTGMYTCMVSNSVGNTTASATLNVTAATTTPFSYFSTVTVETMEPSQDEARTTDNNVGPTPVVDWETTNVTTSLTPQSTRSTEKTFTIPVTDINSGIPGIDEVMKTTK

SEQ ID NO: 2695 - protein, 244 aa, synthetic construct
  REGION 1..244: note = LRRC52 (Q8N7C0) SP+PP+ECD
MSLASGPGPGWLLFSFGMGLVSGSKCPNNCLCQAQEVICTGKQLTEYPLDIPLNTRRLFLNENRITSLPAMHLGLLSDLVYLDCQNNRIREVMDYTFIGVFKLIYLDLSSNNLTSISPFTFSVLSNLVQLNIANNPHLLSLHKFTFANTTSLRYLDLRNTGLQTLDSAALYHLTTLETLFLSGNPWKCNCSFLDFAIFLIVFHMDPSDDLNATCVEPTELTGWPITRVGNPLRYMCITHLDHKD

SEQ ID NO: 2696 - protein, 631 aa, synthetic construct
  REGION 1..631: note = LRRN1 (Q6UXK5) SP+PP+ECD
MARMSFVIAACQLVLGLLMTSLTESSIQNSECPQLCVCEIRPWFTPQSTYREATTVDCNDLRLTRIPSNLSSDTQVLLLQSNNIAKTVDELQQLFNLTELDFSQNNFTNIKEVGLANLTQLTTLHLEENQITEMTDYCLQDLSNLQELYINHNQISTISAHAFAGLKNLLRLHLNSNKLKVIDSRWFDSTPNLEILMIGENPVIGILDMNFKPLANLRSLVLAGMYLTDIPGNALVGLDSLESLSFYDNKLVKVPQLALQKVPNLKFLDLNKNPIHKIQEGDFKNMLRLKELGINNMGELVSVDRYALDNLPELTKLEATNNPKLSYIHRLAFRSVPALESLMLNNNALNAIYQKTVESLPNLREISIHSNPLRCDCVIHWINSNKTNIRFMEPLSMFCAMPPEYKGHQVKEVLIQDSSEQCLPMISHDSFPNRLNVDIGTTVFLDCRAMAEPEPEIYWVTPIGNKITVETLSDKYKLSSEGTLEISNIQIEDSGRYTCVAQNVQGADTRVATIKVNGTLLDGTQVLKIYVKQTESHSILVSWKVNSNVMTSNLKWSSATMKIDNPHITYTARVPVDVHEYNLTHLQPSTDYEVCLTVSNIHQQTQKSCVNVTTKNAAFAVDISDQETSTA

SEQ ID NO: 2697 - protein, 630 aa, synthetic construct
  REGION 1..630: note = LRRN2 (O75325) SP+PP+ECD
MRLLVAPLLLAWVAGATAAVPVVPWHVPCPPQCACQIRPWYTPRSSYREATTVDCNDLFLTAVPPALPAGTQTLLLQSNSIVRVDQSELGYLANLTELDLSQNSFSDARDCDFHALPQLLSLHLEENQLTRLEDHSFAGLASLQELYLNHNQLYRIAPRAFSGLSNLLRLHLNSNLLRAIDSRWFEMLPNLEILMIGGNKVDAILDMNFRPLANLRSLVLAGMNLREISDYALEGLQSLESLSFYDNQLARVPRRALEQVPGLKFLDLNKNPLQRVGPGDFANMLHLKELGLNNMEELVSIDKFALVNLPELTKLDITNNPRLSFIHPRAFHHLPQMETLMLNNNALSALHQQTVESLPNLQEVGLHGNPIRCDCVIRWANATGTRVRFIEPQSTLCAEPPDLQRLPVREVPFREMTDHCLPLISPRSFPPSLQVASGESMVLHCRALAEPEPEIYWVTPAGLRLTPAHAGRRYRVYPEGTLELRRVTAEEAGLYTCVAQNLVGADTKTVSVVVGRALLQPGRDEGQGLELRVQETHPYHILLSWVTPPNTVSTNLTWSSASSLRGQGATALARLPRGTHSYNITRLLQATEYWACLQVAFADAHTQLACVWARTKEATSCHRALGDRPG

SEQ ID NO: 2698 - protein, 628 aa, synthetic construct
  REGION 1..628: note = LRRN3 (Q9H3W5) SP+PP+ECD
MKDMPLRIHVLLGLAITTLVQAVDKKVDCPRLCTCEIRPWFTPRSIYMEASTVDCNDLGLLTFPARLPANTQILLLQTNNIAKIEYSTDFPVNLTGLDLSQNNLSSVTNINVKKMPQLLSVYLEENKLTELPEKCLSELSNLQELYINHNLLSTISPGAFIGLHNLLRLHLNSNRLQMINSKWFDALPNLEILMIGENPIIRIKDMNFKPLINLRSLVIAGINLTEIPDNALVGLENLESISFYDNRLIKVPHVALQKVVNLKFLDLNKNPINRIRRGDFSNMLHLKELGINNMPELISIDSLAVDNLPDLRKIEATNNPRLSYIHPNAFFRLPKLESLMLNSNALSALYHGTIESLPNLKEISIHSNPIRCDCVIRWMNMNKTNIRFMEPDSLFCVDPPEFQGQNVRQVHFRDMMEICLPLIAPESFPSNLNVEAGSYVSFHCRATAEPQPEIYWITPSGQKLLPNTLTDKFYVHSEGTLDINGVTPKEGGLYTCIATNLVGADLKSVMIKVDGSFPQDNNGSLNIKIRDIQANSVLVSWKASSKILKSSVKWTAFVKTENSHAAQSARIPSDVKVYNLTHLNPSTEYKICIDIPTIYQKNRKKCVNVTTKGLHPDQKEYEKNNTTT

SEQ ID NO: 2699 - protein, 679 aa, synthetic construct
  REGION 1..679: note = LRRN4 (Q8WUT4) SP+PP+ECD
MRQTLPLLLLTVLRPSWADPPQEKVPLFRVTQQGPWGSSGSNATDSPCEGLPAADATALTLANRNLERLPGCLPRTLRSLDASHNLLRALSTSELGHLEQLQVLTLRHNRIAALRWGPGGPAGLHTLDLSYNQLAALPPCTGPALSSLRALALAGNPLRALQPRAFACFPALQLLNLSCTALGRGAQGGIAEAAFAGEDGAPLVTLEVLDLSGTFLERVESGWIRDLPKLTSLYLRKMPRLTTLEGDIFKMTPNLQQLDCQDSPALASVATHIFQDTPHLQVLLFQNCNLSSFPPWTLDSSQVLSINLFGNPLTCSCDLSWLLTDAKRTVLSRAADTMCAPAAGSSGPFSASLSLSQLPGVCQSDQSTTLGASHPPCFNRSTYAQGTTVAPSAAPATRPAGDQQSVSKAPNVGSRTIAAWPHSDAREGTAPSTTNSVAGHSNSSVFPRAASTTRTQHRGEHAPELVLEPDISAASTPLASKLLGPFPTSWDRSISSPQPGQRTHATPQAPNPSLSEGEIPVLLLDDYSEEEEGRKEEVGTPHQDVPCDYHPCKHLQTPCAELQRRWRCRCPGLSGEDTIPDPPRLQGVTETTDTSALVHWCAPNSVVHGYQIRYSAEGWAGNQSVVGVIYATARQHPLYGLSPGTTYRVCVLAANRAGLSQPRSSGWRSPCAAFTTKPS

SEQ ID NO: 2700 - protein, 194 aa, synthetic construct
  REGION 1..194: note = LRRN4CL (Q8ND94) SP+PP+ECD
MLGSPCLLWLLAVTFLVPRAQPLAPQDFEEEEADETETAWPPLPAVPCDYDHCRHLQVPCKELQRVGPAACLCPGLSSPAQPPDPPRMGEVRIAAEEGRAVVHWCAPFSPVLHYWLLLWDGSEAAQKGPPLNATVRRAELKGLKPGGIYVVCVVAANEAGASRVPQAGGEGLEGADIPAFGPCSRLAVPPNPRT

SEQ ID NO: 2701 - protein, 422 aa, synthetic construct
  REGION 1..422: note = LRRTM2 (O43300) SP+PP+ECD
MGLHFKWPLGAPMLAAIYAMSMVLKMLPALGMACPPKCRCEKLLFYCDSQGFHSVPNATDKGSLGLSLRHNHITELERDQFASFSQLTWLHLDHNQISTVKEDAFQGLYKLKELILSSNKIFYLPNTTFTQLINLQNLDLSFNQLSSLHPELFYGLRKLQTLHLRSNSLRTIPVRLFWDCRSLEFLDLSTNRLRSLARNGFAGLIKLRELHLEHNQLTKINFAHFLRLSSLHTLFLQWNKISNLTCGMEWTWGTLEKLDLTGNEIKAIDLTVFETMPNLKILLMDNNKLNSLDSKILNSLRSLTTVGLSGNLWECSARICALASWLGSFQGRWEHSILCHSPDHTQGEDILDAVHGFQLCWNLSTTVTVMATTYRDPTTEYTKRISSSSYHVGDKEIPTTAGIAVTTEEHFPEPDNAIFTQR

SEQ ID NO: 2702 - protein, 419 aa, synthetic construct
  REGION 1..419: note = LRRTM3 (Q86VH5) SP+PP+ECD
MGFNVIRLLSGSAVALVIAPTVLLTMLSSAERGCPKGCRCEGKMVYCESQKLQEIPSSISAGCLGLSLRYNSLQKLKYNQFKGLNQLTWLYLDHNHISNIDENAFNGIRRLKELILSSNRISYFLNNTFRPVTNLRNLDLSYNQLHSLGSEQFRGLRKLLSLHLRSNSLRTIPVRIFQDCRNLELLDLGYNRIRSLARNVFAGMIRLKELHLEHNQFSKLNLALFPRLVSLQNLYLQWNKISVIGQTMSWTWSSLQRLDLSGNEIEAFSGPSVFQCVPNLQRLNLDSNKLTFIGQEILDSWISLNDISLAGNIWECSRNICSLVNWLKSFKGLRENTIICASPKELQGVNVIDAVKNYSICGKSTTERFDLARALPKPTFKPKLPRPKHESKPPLPPTVGATEPGPETDADAEHISFHK

SEQ ID NO: 2703 - protein, 424 aa, synthetic construct
  REGION 1..424: note = LRRTM4 (Q86VH4) SP+PP+ECD
MGFHLITQLKGMSVVLVLLPTLLLVMLTGAQRACPKNCRCDGKIVYCESHAFADIPENISGGSQGLSLRFNSIQKLKSNQFAGLNQLIWLYLDHNYISSVDEDAFQGIRRLKELILSSNKITYLHNKTFHPVPNLRNLDLSYNKLQTLQSEQFKGLRKLIILHLRSNSLKTVPIRVFQDCRNLDFLDLGYNRLRSLSRNAFAGLLKLKELHLEHNQFSKINFAHFPRLFNLRSIYLQWNRIRSISQGLTWTWSSLHNLDLSGNDIQGIEPGTFKCLPNLQKLNLDSNKLTNISQETVNAWISLISITLSGNMWECSRSICPLFYWLKNFKGNKESTMICAGPKHIQGEKVSDAVETYNICSEVQVVNTERSHLVPQTPQKPLIIPRPTIFKPDVTQSTFETPSPSPGFQIPGAEQEYEHVSFHK

SEQ ID NO: 2704 - protein, 288 aa, synthetic construct
  REGION 1..288: note = LRTM1 (Q9HBL6) SP+PP+ECD
MKGELLLFSSVIVLLQVVCSCPDKCYCQSSTNFVDCSQQGLAEIPSHLPPQTRTLHLQDNQIHHLPAFAFRSVPWLMTLNLSNNSLSNLAPGAFHGLQHLQVLNLTQNSLLSLESRLFHSLPQLRELDLSSNNISHLPTSLGETWENLTILAVQQNQLQQLDRALLESMPSVRLLLLKDNLWKCNCHLLGLKLWLEKFVYKGGLTDGIICESPDTWKGKDLLRIPHELYQPCPLPAPDPVSSQAQWPGSAHGVVLRPPENHNAGERELLECELKPKPRPANLRHAIAT

SEQ ID NO: 2705 - protein, 310 aa, synthetic construct
  REGION 1..310: note = LRTM2 (Q8N967) SP+PP+ECD
MLAPGSSPGQRGRLALQWRQVSWITCWIALYAVEALPTCPFSCKCDSRSLEVDCSGLGLTTVPPDVPAATRTLLLLNNKLSALPSWAFANLSSLQRLDLSNNFLDRLPRSIFGDLTNLTELQLRNNSIRTLDRDLLRHSPLLRHLDLSINGLAQLPPGLFDGLLALRSLSLRSNRLQNLDRLTFEPLANLQLLQVGDNPWECDCNLREFKHWMEWFSYRGGRLDQLACTLPKELRGKDMRMVPMEMFNYCSQLEDENSSAGLDIPGPPCTKASPEPAKPKPGAEPEPEPSTACPQKQRHRPASVRRAMGT

SEQ ID NO: 2706 - protein, 227 aa, synthetic construct
  REGION 1..227: note = LTBR (P36941) SP+PP+ECD
MLLPWATSAPGLAWGPLVLGLFGLLAASQPQAVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGTMLM

SEQ ID NO: 2707 - protein, 424 aa, synthetic construct
  REGION 1..424: note = LTK (P29376) SP+PP+ECD
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGSRRWAGGGGGGGGATYVFRVRAGELEPLLVAAGGGGRAYLRPRDRGRTQASPEKLENRSEAPGSGGRGGAAGGGGGWTSRAPSPQAGRSLQEGAEGGQGCSEAWATLGWAAAGGFGGGGGACTAGGGGGGYRGGDASETDNLWADGEDGVSFIHPSSELFLQPLAVTENHGEVEIRRHLNCSHCPLRDCQWQAELQLAECLCPEGMELAVDNVTCMDLHKPPGP

SEQ ID NO: 2708 - protein, 235 aa, synthetic construct
  REGION 1..235: note = LY6G6F (Q5SQ64) SP+PP+ECD
MAVLFLLLFLCGTPQAADNMQAIYVALGEAVELPCPSPPTLHGDEHLSWFCSPAAGSFTTLVAQVQVGRPAPDPGKPGRESRLRLLGNYSLWLEGSKEEDAGRYWCAVLGQHHNYQNWRVYDVLVLKGSQLSARAADGSPCNVLLCSVVPSRRMDSVTWQEGKGPVRGRVQSFWGSEAALLLVCPGEGLSEPRSRRPRIIRCLMTHNKGVSFSLAASIDASPALCAPSTGWDMPW

SEQ ID NO: 2709 - protein, 1666 aa, synthetic construct
  REGION 1..1666: note = LY75 (O60449) SP+PP+ECD
MRTGWATPRRPAGLLMLLFWFFDLAEPSGRAANDPFTIVHGNTGKCIKPVYGWIVADDCDETEDKLWKWVSQHRLFHLHSQKCLGLDITKSVNELRMFSCDSSAMLWWKCEHHSLYGAARYRLALKDGHGTAISNASDVWKKGGSEESLCDQPYHEIYTRDGNSYGRPCEFPFLIDGTWHHDCILDEDHSGPWCATTLNYEYDRKWGICLKPENGCEDNWEKNEQFGSCYQFNTQTALSWKEAYVSCQNQGADLLSINSAAELTYLKEKEGIAKIFWIGLNQLYSARGWEWSDHKPLNFLNWDPDRPSAPTIGGSSCARMDAESGLWQSFSCEAQLPYVCRKPLNNTVELTDVWTYSDTRCDAGWLPNNGFCYLLVNESNSWDKAHAKCKAFSSDLISIHSLADVEVVVTKLHNEDIKEEVWIGLKNINIPTLFQWSDGTEVTLTYWDENEPNVPYNKTPNCVSYLGELGQWKVQSCEEKLKYVCKRKGEKLNDASSDKMCPPDEGWKRHGETCYKIYEDEVPFGTNCNLTITSRFEQEYLNDLMKKYDKSLRKYFWTGLRDVDSCGEYNWATVGGRRRAVTFSNWNFLEPASPGGCVAMSTGKSVGKWEVKDCRSFKALSICKKMSGPLGPEEASPKPDDPCPEGWQSFPASLSCYKVFHAERIVRKRNWEEAERFCQALGAHLSSFSHVDEIKEFLHFLTDQFSGQHWLWIGLNKRSPDLQGSWQWSDRTPVSTIIMPNEFQQDYDIRDCAAVKVFHRPWRRGWHFYDDREFIYLRPFACDTKLEWVCQIPKGRTPKTPDWYNPDRAGIHGPPLIIEGSEYWFVADLHLNYEEAVLYCASNHSFLATITSFVGLKAIKNKIANISGDGQKWWIRISEWPIDDHFTYSRYPWHRFPVTFGEECLYMSAKTWLIDLGKPTDCSTKLPFICEKYNVSSLEKYSPDSAAKVQCSEQWIPFQNKCFLKIKPVSLTFSQASDTCHSYGGTLPSVLSQIEQDFITSLLPDMEATLWIGLRWTAYEKINKWTDNRELTYSNFHPLLVSGRLRIPENFFEEESRYHCALILNLQKSPFTGTWNFTSCSERHFVSLCQKYSEVKSRQTLQNASETVKYLNNLYKIIPKTLTWHSAKRECLKSNMQLVSITDPYQQAFLSVQALLHNSSLWIGLFSQDDELNFGWSDGKRLHFSRWAETNGQLEDCVVLDTDGFWKTVDCNDNQPGAICYYSGNETEKEVKPVDSVKCPSPVLNTPWIPFQNCCYNFIITKNRHMATTQDEVHTKCQKLNPKSHILSIRDEKENNFVLEQLLYFNYMASWVMLGITYRNKSLMWFDKTPLSYTHWRAGRPTIKNEKFLAGLSTDGFWDIQTFKVIEEAVYFHQHSILACKIEMVDYKEEYNTTLPQFMPYEDGIYSVIQKKVTWYEALNMCSQSGGHLASVHNQNGQLFLEDIVKRDGFPLWVGLSSHDGSESSFEWSDGSTFDYIPWKGQTSPGNCVLLDPKGTWKHEKCNSVKDGAICYKPTKSKKLSRLTYSSRCPAAKENGSRWIQYKGHCYKSDQALHSFSEAKKLCSKHDHSATIVSIKDEDENKFVSRLMRENNNITMRVWLGLSQHSVDQSWSWLDGSEVTFVKWENKSKSGVGRCSMLIASNETWKKVECEHGFGRVVCKVPLGPD

SEQ ID NO: 2710 - protein, 454 aa, synthetic construct
  REGION 1..454: note = LY9 (Q9HBG7) SP+PP+ECD
MVAPKSHTDDWAPGPFSSKPQRSQLQIFSSVLQTSLLFLLMGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYEQLQEPQVTMKSVKVSENFSCNITLMCSVKGAEKSVLYSWTPREPHASESNGGSILTVSRTPCDPDLPYICTAQNPVSQRSSLPVHVGQFCTDPGASRGGTTGETVVGVLGEPVTLPLALPACRDTEKVVWLFNTSIISKEREEAATADPLIKSRDPYKNRVWVSSQDCSLKISQLKIEDAGPYHAYVCSEASSVTSMTHVTLLIYRRLRKPKITWSLRHSEDGICRISLTCSVEDGGNTVMYTWTPLQKEAVVSQGESHLNVSWRSSENHPNLTCTASNPVSRSSHQFLSENICSGPERNTK

SEQ ID NO: 2711 - protein, 238 aa, synthetic construct
  REGION 1..238: note = LYVE1 (Q9Y5Y7) SP+PP+ECD
MARCFSLVLLLTSIWTTRLLVQGSLRAEELSIQVSCRIMGITLVSKKANQQLNFTEAKEACRLLGLSLAGKDQVETALKASFETCSYGWVGDGFVVISRISPNPKCGKNGVGVLIWKVPVSRQFAAYCYNSSDTWTNSCIPEIITTKDPIFNTQTATQTTEFIVSDSTYSVASPYSTIPAPTTTPPAPASTSIPRRKKLICVTEVFMETSTMSTETEPFVENKAAFKNEAAGFGGVPT

SEQ ID NO: 2712 - protein, 185 aa, synthetic construct
  REGION 1..185: note = M6PR (P20645) SP+PP+ECD
MFPFYSCWRTGLLLLLLAVAVRESWQTEEKTCDLVGEKGKESEKELALVKRLKPLFNKSFESTVGQGSDTYIYIFRVCREAGNHTSGAGLVQINKSNGKETVVGRLNETHIFNGSNWIMLIYKGGDEYDNHCGKEQRRAVVMISCNRHTLADNFNPVSEERGKVQDCFYLFEMDSSLACSPEISH

SEQ ID NO: 2713 - protein, 516 aa, synthetic construct
  REGION 1..516: note = MAG (P20916) SP+PP+ECD
MIFLTALPLFWIMISASRGGHWGAWMPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVSCMVPDNCPELRPELSWLGHEGLGEPAVLGRLREDEGTWVQVSLLHFVPTREANGHRLGCQASFPNTTLQFEGYASMDVKYPPVIVEMNSSVEAIEGSHVSLLCGADSNPPPLLTWMRDGTVLREAVAESLLLELEEVTPAEDGVYACLAENAYGQDNRTVGLSVMYAPWKPTVNGTMVAVEGETVSILCSTQSNPDPILTIFKEKQILSTVIYESELQLELPAVSPEDDGEYWCVAENQYGQRATAFNLSVEFAPVLLLESHCAAARDTVQCLCVVKSNPEPSVAFELPSRNVTVNESEREFVYSERSGLVLTSILTLRGQAQAPPRVICTARNLYGAKSLELPFQGAHRLMWAKIGP

SEQ ID NO: 2714 - protein, 1151 aa, synthetic construct
  REGION 1..1151: note = MAMDC4 (Q6UXC1) SP+PP+ECD
MPLSSHLLPALVLFLAGSSGWAWVPNHCRSPGQAVCNFVCDCRDCSDEAQCGYHGASPTLGAPFACDFEQDPCGWRDISTSGYSWLRDRAGAALEGPGPHSDHTLGTDLGWYMAVGTHRGKEASTAALRSPTLREAASSCKLRLWYHAASGDVAELRVELTHGAETLTLWQSTGPWGPGWQELAVTTGRIRGDFRVTFSATRNATHRGAVALDDLEFWDCGLPTPQANCPPGHHHCQNKVCVEPQQLCDGEDNCGDLSDENPLTCGRHIATDFETGLGPWNRSEGWSRNHRAGGPERPSWPRRDHSRNSAQGSFLVSVAEPGTPAILSSPEFQASGTSNCSLVFYQYLSGSEAGCLQLFLQTLGPGAPRAPVLLRRRRGELGTAWVRDRVDIQSAYPFQILLAGQTGPGGVVGLDDLILSDHCRPVSEVSTLQPLPPGPRAPAPQPLPPSSRLQDSCKQGHLACGDLCVPPEQLCDFEEQCAGGEDEQACGTTDFESPEAGGWEDASVGRLQWRRVSAQESQGSSAAAAGHFLSLQRAWGQLGAEARVLTPLLGPSGPSCELHLAYYLQSQPRGFLALVVVDNGSRELAWQALSSSAGIWKVDKVLLGARRRPFRLEFVGLVDLDGPDQQGAGVDNVTLRDCSPTVTTERDREVSCNFERDTCSWYPGHLSDTHWRWVESRGPDHDHTTGQGHFVLLDPTDPLAWGHSAHLLSRPQVPAAPTECLSFWYHLHGPQIGTLRLAMRREGEETHLWSRSGTQGNRWHEAWATLSHQPGSHAQYQLLFEGLRDGYHGTMALDDVAVRPGPCWAPNYCSFEDSDCGFSPGGQGLWRRQANASGHAAWGPPTDHTTETAQGHYMVVDTSPDALPRGQTASLTSKEHRPLAQPACLTFWYHGSLRSPGTLRVYLEERGRHQVLSLSAHGGLAWRLGSMDVQAERAWRVVFEAVAAGVAHSYVALDDLLLQDGPCPQPGSCDFESGLCGWSHLAWPGLGGYSWDWGGGATPSRYPQPPVDHTLGTEAGHFAFFETGVLGPGGRAAWLRSEPLPATPASCLRFWYHMGFPEHFYKGELKVLLHSAQGQLAVWGAGGHRRHQWLEAQVEVASAKEFQIVFEATLGGQPALGPIALDDVEYLAGQHCQQPAPSPGNTAAPGS

SEQ ID NO: 2715 - protein, 385 aa, synthetic construct
  REGION 1..385: note = MANSC1 (Q9H8J5) SP+PP+ECD
MFFGGEGSLTYTLVIICFLTLRLSASQNCLKKSLEDVVIDIQSSLSKGIRGNEPVYTSTQEDCINSCCSTKNISGDKACNLMIFDTRKTARQPNCYLFFCPNEEACPLKPAKGLMSYRIITDFPSLTRNLPSQELPQEDSLLHGQFSQAVTPLAHHHTDYSKPTDISWRDTLSQKFGSSDHLEKLFKMDEASAQLLAYKEKGHSQSSQFSSDQEIAHLLPENVSALPATVAVASPHTTSATPKPATLLPTNASVTPSGTSQPQLATTAPPVTTVTSQPPTTLISTVFTRAAATLQAMATTAVLTTTFQAPTDSKGSLETIPFTEISNLTLNTGNVYNPTALSMSNVESSTMNKTASWEGREASPGSSSQGSVPENQYGLPFEKWL

SEQ ID NO: 2716 - protein, 284 aa, synthetic construct
  REGION 1..284: note = MANSC4 (A6NHS7) SP+PP+ECD
MHVAEVAVNVILLLSMGWTSDSLCSPTIFYRDCWIRRFPGLLINLEESQKLGAQFLKYYSESTGQKCSRSCCLRKDVSCNLAVFYHSPIHDNINCLHVHCPTLESCILEPGTSAILYNITDGIDPDLLVFEQSPTYLNTRSSSNRWDRLRILKAMNLDKQTTTINGMLPSTEAPSSTTHQDLVVNTNSTSYSKELTTDFWARFTSLNESITTKINKVSPSTDFISNPDNKTISPFFEPIDTKLSHMPVPPGLNSSKQLLNKTKGYNSRNHTSANEDEVSVTSKT

SEQ ID NO: 2717 - protein, 559 aa, synthetic construct
  REGION 1..559: note = MCAM (P43121) SP+PP+ECD
MGLPRLVCAFLLAACCCCPRVAGVPGEAEQPAPELVEVEVGSTALLKCGLSQSQGNLSHVDWFSVHKEKRTLIFRVRQGQGQSEPGEYEQRLSLQDRGATLALTQVTPQDERIFLCQGKRPRSQEYRIQLRVYKAPEEPNIQVNPLGIPVNSKEPEEVATCVGRNGYPIPQVIWYKNGRPLKEEKNRVHIQSSQTVESSGLYTLQSILKAQLVKEDKDAQFYCELNYRLPSGNHMKESREVTVPVFYPTEKVWLEVEPVGMLKEGDRVEIRCLADGNPPPHFSISKQNPSTREAEEETTNDNGVLVLEPARKEHSGRYECQGLDLDTMISLLSEPQELLVNYVSDVRVSPAAPERQEGSSLTLTCEAESSQDLEFQWLREETGQVLERGPVLQLHDLKREAGGGYRCVASVPSIPGLNRTQLVNVAIFGPPWMAFKERKVWVKENMVLNLSCEASGHPRPTISWNVNGTASEQDQDPQRVLSTLNVLVTPELLETGVECTASNDLGKNTSILFLELVNLTTLTPDSNTTTGLSTSTASPHTRANSTSTERKLPEPESRG

SEQ ID NO: 2718 - protein, 857 aa, synthetic construct
  REGION 1..857: note = MEGF10 (Q96KG7) SP+PP+ECD
MVISLNSCLSFICLLLCHWIGTASPLNLEDPNVCSHWESYSVTVQESYPHPFDQIYYTSCTDILNWFKCTRHRVSYRTAYRHGEKTMYRRKSQCCPGFYESGEMCVPHCADKCVHGRCIAPNTCQCEPGWGGTNCSSACDGDHWGPHCTSRCQCKNGALCNPITGACHCAAGFRGWRCEDRCEQGTYGNDCHQRCQCQNGATCDHVTGECRCPPGYTGAFCEDLCPPGKHGPQCEQRCPCQNGGVCHHVTGECSCPSGWMGTVCGQPCPEGRFGKNCSQECQCHNGGTCDAATGQCHCSPGYTGERCQDECPVGTYGVLCAETCQCVNGGKCYHVSGACLCEAGFAGERCEARLCPEGLYGIKCDKRCPCHLENTHSCHPMSGECACKPGWSGLYCNETCSPGFYGEACQQICSCQNGADCDSVTGKCTCAPGFKGIDCSTPCPLGTYGINCSSRCGCKNDAVCSPVDGSCTCKAGWHGVDCSIRCPSGTWGFGCNLTCQCLNGGACNTLDGTCTCAPGWRGEKCELPCQDGTYGLNCAERCDCSHADGCHPTTGHCRCLPGWSGVHCDSVCAEGRWGPNCSLPCYCKNGASCSPDDGICECAPGFRGTTCQRICSPGFYGHRCSQTCPQCVHSSGPCHHITGLCDCLPGFTGALCNEVCPSGRFGKNCAGICTCTNNGTCNPIDRSCQCYPGWIGSDCSQPCPPAHWGPNCIHTCNCHNGAFCSAYDGECKCTPGWTGLYCTQRCPLGFYGKDCALICQCQNGADCDHISGQCTCRTGFMGRHCEQKCPSGTYGYGCRQICDCLNNSTCDHITGTCYCSPGWKGARCDQAGVIIVGNLNSLSRTSTALPADSYQIG

SEQ ID NO: 2719 - protein, 848 aa, synthetic construct
  REGION 1..848: note = MEGF11 (A6BM72) SP+PP+ECD
MVLSLTGLIAFSFLQATLALNPEDPNVCSHWESYAVTVQESYAHPFDQIYYTRCTDILNWFKCTRHRISYKTAYRRGLRTMYRRRSQCCPGYYESGDFCIPLCTEECVHGRCVSPDTCHCEPGWGGPDCSSGCDSDHWGPHCSNRCQCQNGALCNPITGACVCAAGFRGWRCEELCAPGTHGKGCQLPCQCRHGASCDPRAGECLCAPGYTGVYCEELCPPGSHGAHCELRCPCQNGGTCHHITGECACPPGWTGAVCAQPCPPGTFGQNCSQDCPCHHGGQCDHVTGQCHCTAGYMGDRCQEECPFGSFGFQCSQHCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPCPDGTFGLNCSEHCDCSHADGCDPVTGHCCCLAGWTGIRCDSTCPPGRWGPNCSVSCSCENGGSCSPEDGSCECAPGFRGPLCQRICPPGFYGHGCAQPCPLCVHSSRPCHHISGICECLPGFSGALCNQVCAGGYFGQDCAQLCSCANNGTCSPIDGSCQCFPGWIGKDCSQACPPGFWGPACFHACSCHNGASCSAEDGACHCTPGWTGLFCTQRCPAAFFGKDCGRVCQCQNGASCDHISGKCTCRTGFTGQHCEQRCAPGTFGYGCQQLCECMNNSTCDHVTGTCYCSPGFKGIRCDQAALMMEELNPYTKISPALGAERHS

SEQ ID NO: 2720 - protein, 2845 aa, synthetic construct
  REGION 1..2845: note = MEGF8 (Q7Z7M0) SP+PP+ECD
MALGKVLAMALVLALAVLGSLSPGARAGDCKGQRQVLREAPGFVTDGAGNYSVNGNCEWLIEAPSPQHRILLDFLFLDTECTYDYLFVYDGDSPRGPLLASLSGSTRPPPIEASSGKMLLHLFSDANYNLLGFNASFRFSLCPGGCQSHGQCQPPGVCACEPGWGGPDCGLQECSAYCGSHGTCASPLGPCRCEPGFLGRACDLHLWENQGAGWWHNVSARDPAFSARIGAAGAFLSPPGLLAVFGGQDLNNALGDLVLYNFSANTWESWDLSPAPAARHSHVAVAWAGSLVLMGGELADGSLTNDVWAFSPLGRGHWELLAPPASSSSGPPGLAGHAAALVDDVWLYVSGGRTPHDLFSSGLFRFRLDSTSGGYWEQVIPAGGRPPAATGHSMVFHAPSRALLVHGGHRPSTARFSVRVNSTELFHVDRHVWTTLKGRDGLQGPRERAFHTASVLGNYMVVYGGNVHTHYQEEKCYEDGIFFYHLGCHQWVSGAELAPPGTPEGRAAPPSGRYSHVAAVLGGSVLLVAGGYSGRPRGDLMAYKVPPFVFQAPAPDYHLDYCSMYTDHSVCSRDPECSWCQGACQAAPPPGTPLGACPAASCLGLGRLLGDCQACLAFSSPTAPPRGPGTLGWCVHNESCLPRPEQARCRGEQISGTVGWWGPAPVFVTSLEACVTQSFLPGLHLLTFQQPPNTSQPDKVSIVRSTTITLTPSAETDVSLVYRGFIYPMLPGGPGGPGAEDVAVWTRAQRLHVLARMARGPDTENMEEVGRWVAHQEKETRRLQRPGSARLFPLPGRDHKYAVEIQGQLNGSAGPGHSELTLLWDRTGVPGGSEISFFFLEPYRSSSCTSYSSCLGCLADQGCGWCLTSATCHLRQGGAHCGDDGAGGSLLVLVPTLCPLCEEHRDCHACTQDPFCEWHQSTSRKGDAACSRRGRGRGALKSPEECPPLCSQRLTCEDCLANSSQCAWCQSTHTCFLFAAYLARYPHGGCRGWDDSVHSEPRCRSCDGFLTCHECLQSHECGWCGNEDNPTLGRCLQGDFSGPLGGGNCSLWVGEGLGLPVALPARWAYARCPDVDECRLGLARCHPRATCLNTPLSYECHCQRGYQGDGISHCNRTCLEDCGHGVCSGPPDFTCVCDLGWTSDLPPPTPAPGPPAPRCSRDCGCSFHSHCRKRGPGFCDECQDWTWGEHCERCRPGSFGNATGSRGCRPCQCNGHGDPRRGHCDNLSGLCFCQDHTEGAHCQLCSPGYYGDPRAGGSCFRECGGRALLTNVSSVALGSRRVGGLLPPGGGAARAGPGLSYCVWVVSATEELQPCAPGTLCPPLTLTFSPDSSTPCTLSYVLAFDGFPRFLDTGVVQSDRSLIAAFCGQRRDRPLTVQALSGLLVLHWEANGSSSWGFNASVGSARCGSGGPGSCPVPQECVPQDGAAGAGLCRCPQGWAGPHCRMALCPENCNAHTGAGTCNQSLGVCICAEGFGGPDCATKLDGGQLVWETLMDSRLSADTASRFLHRLGHTMVDGPDATLWMFGGLGLPQGLLGNLYRYSVSERRWTQMLAGAEDGGPGPSPRSFHAAAYVPAGRGAMYLLGGLTAGGVTRDFWVLNLTTLQWRQEKAPQTVELPAVAGHTLTARRGLSLLLVGGYSPENGFNQQLLEYQLATGTWVSGAQSGTPPTGLYGHSAVYHEATDSLYVFGGFRFHVELAAPSPELYSLHCPDRTWSLLAPSQGAKRDRMRNVRGSSRGLGQVPGEQPGSWGFREVRKKMALWAALAGTGGFLEEISPHLKEPRPRLFHASALLGDTMVVLGGRSDPDEFSSDVLLYQVNCNAWLLPDLTRSASVGPPMEESVAHAVAAVGSRLYISGGFGGVALGRLLALTLPPDPCRLLSSPEACNQSGACTWCHGACLSGDQAHRLGCGGSPCSPMPRSPEECRRLRTCSECLARHPRTLQPGDGEASTPRCKWCTNCPEGACIGRNGSCTSENDCRINQREVFWAGNCSEAACGAADCEQCTREGKCMWTRQFKRTGETRRILSVQPTYDWTCFSHSLLNVSPMPVESSPPLPCPTPCHLLPNCTSCLDSKGADGGWQHCVWSSSLQQCLSPSYLPLRCMAGGCGRLLRGPESCSLGCAQATQCALCLRRPHCGWCAWGGQDGGGRCMEGGLSGPRDGLTCGRPGASWAFLSCPPEDECANGHHDCNETQNCHDQPHGYECSCKTGYTMDNMTGLCRPVCAQGCVNGSCVEPDHCRCHFGFVGRNCSTECRCNRHSECAGVGARDHCLLCRNHTKGSHCEQCLPLFVGSAVGGGTCRPCHAFCRGNSHICISRKELQMSKGEPKKYSLDPEEIENWVTEGPSEDEAVCVNCQNNSYGEKCESCLQGYFLLDGKCTKCQCNGHADTCNEQDGTGCPCQNNTETGTCQGSSPSDRRDCYKYQCAKCRESFHGSPLGGQQCYRLISVEQECCLDPTSQTNCFHEPKRRALGPGRTVLFGVQPKFTNVDIRLTLDVTFGAVDLYVSTSYDTFVVRVAPDTGVHTVHIQPPPAPPPPPPPADGGPRGAGDPGGAGASSGPGAPAEPRVREVWPRGLITYVTVTEPSAVLVVRGVRDRLVITYPHEHHALKSSRFYLLLLGVGDPSGPGANGSADSQGLLFFRQDQAHIDLFVFFSVFFSCFFLFLSLCVLLWKAKQALDQRQEQRRHLQEMTKMASRPFAKVTVCFPPDPTAPASAWKPAGLPPPAFRRSEPFLAPLLLTGAGGPWGPMGGGCCPPAIPATTAGLRAGPITLEPTEDGMAGVATLLLQLPGGPHAPNGACLGSALVTLRHRLHEYCGGGGGAGGSGHGTGAGRKGLLSQDNLTSMSL

SEQ ID NO: 2721 - protein, 514 aa, synthetic construct
  REGION 1..514: note = MEGF9 (Q9H1U4) SP+PP+ECD
MNGGAERAMRSLPSLGGLALLCCAAAAAAAAVASAASAGNVTGGGGAAGQVDASPGPGLRGEPSHPFPRATAPTAQAPRTGPPRATVHRPLAATSPAQSPETTPLWATAGPSSTTFQAPLGPSPTTPPAAERTSTTSQAPTRPAPTTLSTTTGPAPTTPVATTVPAPTTPRTPTPDLPSSSNSSVLPTPPATEAPSSPPPEYVCNCSVVGSLNVNRCNQTTGQCECRPGYQGLHCETCKEGFYLNYTSGLCQPCDCSPHGALSIPCNSSGKCQCKVGVIGSICDRCQDGYYGFSKNGCLPCQCNNRSASCDALTGACLNCQENSKGNHCEECKEGFYQSPDATKECLRCPCSAVTSTGSCSIKSSELEPECDQCKDGYIGPNCNKCENGYYNFDSICRKCQCHGHVDPVKTPKICKPESGECINCLHNTTGFWCENCLEGYVHDLEGNCIKKEVILPTPEGSTILVSNASLTTSVPTPVINSTFTPTTLQTIFSVSTSENSTSALADVSWTQFN

SEQ ID NO: 2722 - protein, 712 aa, synthetic construct
  REGION 1..712: note = MEP1A (Q16819) SP+PP+ECD
MAWIRSTCILFFTLLFAHIAAVPIKYLPEENVHDADFGEQKDISEINLAAGLDLFQGDILLQKSRNGLRDPNTRWTFPIPYILADNLGLNAKGAILYAFEMFRLKSCVDFKPYEGESSYIIFQQFDGCWSEVGDQHVGQNISIGQGCAYKAIIEHEILHALGFYHEQSRTDRDDYVNIWWDQILSGYQHNFDTYDDSLITDLNTPYDYESLMHYQPFSFNKNASVPTITAKIPEFNSIIGQRLDFSAIDLERLNRMYNCTTTHTLLDHCTFEKANICGMIQGTRDDTDWAHQDSAQAGEVDHTLLGQCTGAGYFMQFSTSSGSAEEAALLESRILYPKRKQQCLQFFYKMTGSPSDRLVVWVRRDDSTGNVRKLVKVQTFQGDDDHNWKIAHVVLKEEQKFRYLFQGTKGDPQNSTGGIYLDDITLTETPCPTGVWTVRNFSQVLENTSKGDKLQSPRFYNSEGYGFGVTLYPNSRESSGYLRLAFHVCSGENDAILEWPVENRQVIITILDQEPDVRNRMSSSMVFTTSKSHTSPAINDTVIWDRPSRVGTYHTDCNCFRSIDLGWSGFISHQMLKRRSFLKNDDLIIFVDFEDITHLSQTEVPTKGKRLSPQGLILQGQEQQVSEEGSGKAMLEEALPVSLSQGQPSRQKRSVENTGPLEDHNWPQYFRDPCDPNPCQNDGICVNVKGMASCRCISGHAFFYTGERCQAV

SEQ ID NO: 2723 - protein, 691 aa, synthetic construct
  REGION 1..691: note = MEP1B (Q16820) SP+PP+ECD
MDLWNLSWFLFLDALLVISGLATPENFDVDGGMDQDIFDINEGLGLDLFEGDIRLDRAQIRTPENFDVDGGMDQDIFDINEGLGLDLFEGDIRLDRAQIRNSIIGEKYRWPHTIPYVLEDSLEMNAKGVILNAFERYRLKTCIDFKPWAGETNYISVFKGSGCWSSVGNRRVGKQELSIGANCDRIATVQHEFLHALGFWHEQSRSDRDDYVRIMWDRILSGREHNFNTYSDDISDSLNVPYDYTSVMHYSKTAFQNGTEPTIVTRISDFEDVIGQRMDFSDSDLLKLNQLYNCSSSLSFMDSCSFELENVCGMIQSSGDNADWQRVSQVPRGPESDHSNMGQCQGSGFFMHFDSSSVNVGATAVLESRTLYPKRGFQCLQFYLYNSGSESDQLNIYIREYSADNVDGNLTLVEEIKEIPTGSWQLYHVTLKVTKKFRVVFEGRKGSGASLGGLSIDDINLSETRCPHHIWHIRNFTQFIGSPNGTLYSPPFYSSKGYAFQIYLNLAHVTNAGIYFHLISGANDDQLQWPCPWQQATMTLLDQNPDIRQRMSNQRSITTDPFMTTDNGNYFWDRPSKVGTVALFSNGTQFRRGGGYGTSAFITHERLKSRDFIKGDDVYILLTVEDISHLNSTQIQLTPAPSVQDLCSKTTCKNDGVCTVRDGKAECRCQSGEDWWYMGERCEKRGSTRDT

SEQ ID NO: 2724 - protein, 505 aa, synthetic construct
  REGION 1..505: note = MERTK (Q12866) SP+PP+ECD
MGPAPLPLLLGLFLPALWRRAITEAREEAKPYPLFPGPFPGSLQTDHTPLLSLPHASGYQPALMFSPTQPGRPHTGNVAIPQVTSVESKPLPPLAFKHTVGHIILSEHKGVKFNCSISVPNIYQDTTISWWKDGKELLGAHHAITQFYPDDEVTAIIASFSITSVQRSDNGSYICKMKINNEEIVSDPIYIEVQGLPHFTKQPESMNVTRNTAFNLTCQAVGPPEPVNIFWVQNSSRVNEQPEKSPSVLTVPGLTEMAVFSCEAHNDKGLTVSKGVQINIKAIPSPPTEVSIRNSTAHSILISWVPGFDGYSPFRNCSIQVKEADPLSNGSVMIFNTSALPHLYQIKQLQALANYSIGVSCMNEIGWSAVSPWILASTTEGAPSVAPLNVTVFLNESSDNVDIRWMKPPTKQQDGELVGYRISHVWQSAGISKELLEEVGQNGSRARISVQVHNATCTVRIAAVTRGGVGPFSDPVKIFIPAHGWVDYAPSSTPAPGNADPVLII

SEQ ID NO: 2725 - protein, 932 aa, synthetic construct
  REGION 1..932: note = MET (P08581) SP+PP+ECD
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFT

SEQ ID NO: 2726 - protein, 147 aa, synthetic construct
  REGION 1..147: note = MFAP3 (P55082) SP+PP+ECD
MKLHCCLFTLVASIIVPAAFVLEDVDFDQMVSLEANRSSYNASFPSSFELSASSHSDDDVIIAKEGTSVSIECLLTASHYEDVHWHNSKGQQLDGRSRGGKWLVSDNFLNITNVAFDDRGLYTCFVTSPIRASYSVTLRVIFTSGDM

SEQ ID NO: 2727 - protein, 149 aa, synthetic construct
  REGION 1..149: note = MFAP3L (O75121) SP+PP+ECD
MDRLKSHLTVCFLPSVPFLILVSTLATAKSVTNSTLNGTNVVLGSVPVIIARTDHIIVKEGNSALINCSVYGIPDPQFKWYNSIGKLLKEEEDEKERGGGKWQMHDSGLLNITKVSFSDRGKYTCVASNIYGTVNNTVTLRVIFTSGDM

SEQ ID NO: 2728 - protein, 307 aa, synthetic construct
  REGION 1..307: note = MICA (Q29983) SP+PP+ECD
MGLGPVFLLLAGIFPFAPPGAAAEPHSLRYNLTVLSWDGSVQSGFLTEVHLDGQPFLRCDRQKCRAKPQGQWAEDVLGNKTWDRETRDLTGNGKDLRMTLAHIKDQKEGLHSLQEIRVCEIHEDNSTRSSQHFYYDGELFLSQNLETKEWTMPQSSRAQTLAMNVRNFLKEDAMKTKTHYHAMHADCLQELRRYLKSGVVLRRTVPPMVNVTRSEASEGNITVTCRASGFYPWNITLSWRQDGVSLSHDTQQWGDVLPDGNGTYQTWVATRICQGEEQRFTCYMEHSGNHSTHPVPSGKVLVLQSHW

SEQ ID NO: 2729 - protein, 309 aa, synthetic construct
  REGION 1..309: note = MICB (Q29980) SP+PP+ECD
MGLGRVLLFLAVAFPFAPPAAAAEPHSLRYNLMVLSQDESVQSGFLAEGHLDGQPFLRYDRQKRRAKPQGQWAEDVLGAKTWDTETEDLTENGQDLRRTLTHIKDQKGGLHSLQEIRVCEIHEDSSTRGSRHFYYDGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKVLVLQSQRTD

SEQ ID NO: 2730 - protein, 227 aa, synthetic construct
  REGION 1..227: note = MILR1 (Q7Z6M3) SP+PP+ECD
MWSHLNRLLFWSIFSSVTCRKAVLDCEAMKTNEFPSPCLDSKTKVVMKGQNVSMFCSHKNKSLQITYSLFRRKTHLGTQDGKGEPAIFNLSITEAHESGPYKCKAQVTSCSKYSRDFSFTIVDPVTSPVLNIMVIQTETDRHITLHCLSVNGSLPINYTFFENHVAISPAISKYDREPAEFNLTKKNPGEEEEYRCEAKNRLPNYATYSHPVTMPSTGGDSCPFCLK

SEQ ID NO: 2731 - protein, 541 aa, synthetic construct
  REGION 1..541: note = MMP14 (P50281) SP+PP+ECD
MSPAPRPPRCLLLPLLTLGTALASLGSAQSSSFSPEAWLQQYGYLPPGDLRTHTQRSPQSLSAAIAAMQKFYGLQVTGKADADTMKAMRRPRCGVPDKFGAEIKANVRRKRYAIQGLKWQHNEITFCIQNYTPKVGEYATYEAIRKAFRVWESATPLRFREVPYAYIREGHEKQADIMIFFAEGFHGDSTPFDGEGGFLAHAYFPGPNIGGDTHFDSAEPWTVRNEDLNGNDIFLVAVHELGHALGLEHSSDPSAIMAPFYQWMDTENFVLPDDDRRGIQQLYGGESGFPTKMPPQPRTTSRPSVPDKPKNPTYGPNICDGNFDTVAMLRGEMFVFKERWFWRVRNNQVMDGYPMPIGQFWRGLPASINTAYERKDGKFVFFKGDKHWVFDEASLEPGYPKHIKELGRGLPTDKIDAALFWMPNGKTYFFRGNKYYRFNEELRAVDSEYPKNIKVWEGIPESPRGSFMGSDEVFTYFYKGNKYWKFNNQKLKVEPGYPKSALRDWMGCPSGGRPDEGTEEETEVIIIEVDEEGGGAVSAAA

SEQ ID NO: 2732 - protein, 564 aa, synthetic construct
  REGION 1..564: note = MMP16 (P51512) SP+PP+ECD
MILLTFSTGRRLDFVHHSGVFFLQTLLWILCATVCGTEQYFNVEVWLQKYGYLPPTDPRMSVLRSAETMQSALAAMQQFYGINMTGKVDRNTIDWMKKPRCGVPDQTRGSSKFHIRRKRYALTGQKWQHKHITYSIKNVTPKVGDPETRKAIRRAFDVWQNVTPLTFEEVPYSELENGKRDVDITIIFASGFHGDSSPFDGEGGFLAHAYFPGPGIGGDTHFDSDEPWTLGNPNHDGNDLFLVAVHELGHALGLEHSNDPTAIMAPFYQYMETDNFKLPNDDLQGIQKIYGPPDKIPPPTRPLPTVPPHRSIPPADPRKNDRPKPPRPPTGRPSYPGAKPNICDGNFNTLAILRREMFVFKDQWFWRVRNNRVMDGYPMQITYFWRGLPPSIDAVYENSDGNFVFFKGNKYWVFKDTTLQPGYPHDLITLGSGIPPHGIDSAIWWEDVGKTYFFKGDRYWRYSEEMKTMDPGYPKPITVWKGIPESPQGAFVHKENGFTYFYKGKEYWKFNNQILKVEPGYPRSILKDFMGCDGPTDRVKEGHSPPDDVDIVIKLDNTASTVKA

SEQ ID NO: 2733 - protein, 655 aa, synthetic construct
  REGION 1..655: note = MPEG1 (Q2M385) SP+PP+ECD
MNNFRATILFWAAAAWAKSGKPSGEMDEVGVQKCKNALKLPVLEVLPGGGWDNLRNVDMGRVMELTYSNCRTTEDGQYIIPDEIFTIPQKQSNLEMNSEILESWANYQSSTSYSINTELSLFSKVNGKFSTEFQRMKTLQVKDQAITTRVQVRNLVYTVKINPTLELSSGFRKELLDISDRLENNQTRMATYLAELLVLNYGTHVTTSVDAGAALIQEDHLRASFLQDSQSSRSAVTASAGLAFQNTVNFKFEENYTSQNVLTKSYLSNRTNSRVQSIGGVPFYPGITLQAWQQGITNHLVAIDRSGLPLHFFINPNMLPDLPGPLVKKVSKTVETAVKRYYTFNTYPGCTDLNSPNFNFQANTDDGSCEGKMTNFSFGGVYQECTQLSGNRDVLLCQKLEQKNPLTGDFSCPSGYSPVHLLSQIHEEGYNHLECHRKCTLLVFCKTVCEDVFQVAKAEFRAFWCVASSQVPENSGLLFGGLFSSKSINPMTNAQSCPAGYFPLRLFENLKVCVSQDYELGSRFAVPFGGFFSCTVGNPLVDPAISRDLGAPSLKKCPGGFSQHPALISDGCQVSYCVKSGLFTGGSLPPARLPPFTRPPLMSQAATNTVIVTNSENARSWIKDSQTHQWRLGEPIELRRAMNVIHGDGGGLSGG

SEQ ID NO: 2734 - protein, 491 aa, synthetic construct
  REGION 1..491: note = MPL (P40238) SP+PP+ECD
MPSWALFMVTSCLLLAPQNLAQVSSQDVSLLASDSEPLKCFSRTFEDLTCFWDEEEAAPSGTYQLLYAYPREKPRACPLSSQSMPHFGTRYVCQFPDQEEVRLFFPLHLWVKNVFLNQTRTQRVLFVDSVGLPAPPSIIKAMGGSQPGELQISWEEPAPEISDFLRYELRYGPRDPKNSTGPTVIQLIATETCCPALQRPHSASALDQSPCAQPTMPWQDGPKQTSPSREASALTAEGGSCLISGLQPGNSYWLQLRSEPDGISLGGSWGSWSLPVTVDLPGDAVALGLQCFTLDLKNVTCQWQQQDHASSQGFFYHSRARCCPRDRYPIWENCEEEEKTNPGLQTPQFSRCHFKSRNDSIIHILVEVTTAPGTVHSYLGSPFWIHQAVRLPTPNLHWREISSGHLELEWQHPSSWAAQETCYQLRYTGEGHQDWKVLEPPLGARGGTLELRPRSRYRLQLRARLNGPTYQGPWSSWSDPTRVETATETAW

SEQ ID NO: 2735 - protein, 153 aa, synthetic construct
  REGION 1..153: note = MPZ (P25189) SP+PP+ECD
MAPGAPSSSPSPILAVLLFSSLVLSPAQAIVVYTDREVHGAVGSRVTLHCSFWSSEWVSDDISFTWRYQPEGGRDAISIFHYAKGQPYIDEVGTFKERIQWVGDPRWKDGSIVIHNLDYSDNGTFTCDVKNPPDIVGKTSQVTLYVFEKVPTR

SEQ ID NO: 2736 - protein, 162 aa, synthetic construct
  REGION 1..162: note = MPZL1 (O95297) SP+PP+ECD
MAASAGAGAVIAAPDSRRWLWSVLAAALGLLTAGVSALEVYTPKEIFVANGTQGKLTCKFKSTSTTGGLTSVSWSFQPEGADTTVSFFHYSQGQVYLGNYPPFKDRISWAGDLDKKDASINIENMQFIHNGTYICDVKNPPDIVVQPGHIRLYVVEKENLPV

SEQ ID NO: 2737 - protein, 154 aa, synthetic construct
  REGION 1..154: note = MPZL2 (O60487) SP+PP+ECD
MYGKSSTRAVLLLLGIQLTALWPIAAVEIYTSRVLEAVNGTDARLKCTFSSFAPVGDALTVTWNFRPLDGGPEQFVFYYHIDPFQPMSGRFKDRVSWDGNPERYDASILLWKLQFDDNGTYTCQVKNPPDVDGVIGEIRLSVVHTVRFSEIHFL

SEQ ID NO: 2738 - protein, 158 aa, synthetic construct
  REGION 1..158: note = MPZL3 (Q6UWV2) SP+PP+ECD
MQQRGAAGSRGCALFPLLGVLFFQGVYIVFSLEIRADAHVRGYVGEKIKLKCTFKSTSDVTDKLTIDWTYRPPSSSHTVSIFHYQSFQYPTTAGTFRDRISWVGNVYKGDASISISNPTIKDNGTFSCAVKNPPDVHHNIPMTELTVTERGFGTMLSS

SEQ ID NO: 2739 - protein, 302 aa, synthetic construct
  REGION 1..302: note = MR1 (Q95460) SP+PP+ECD
MGELMAFLLPLIIVLMVKHSDSRTHSLRYFRLGVSDPIHGVPEFISVGYVDSHPITTYDSVTRQKEPRAPWMAENLAPDHWERYTQLLRGWQQMFKVELKRLQRHYNHSGSHTYQRMIGCELLEDGSTTGFLQYAYDGQDFLIFNKDTLSWLAVDNVAHTIKQAWEANQHELLYQKNWLEEECIAWLKRFLEYGKDTLQRTEPPLVRVNRKETFPGVTALFCKAHGFYPPEIYMTWMKNGEEIVQEIDYGDILPSGDGTYQAWASIELDPQSSNLYSCHVEHCGVHMVLQVPQESETIPLVM

SEQ ID NO: 2740 - protein, 1389 aa, synthetic construct
  REGION 1..1389: note = MRC1 (P22897) SP+PP+ECD
MRLPLLLVFASVIPGAVLLLDTRQFLIYNEDHKRCVDAVSPSAVQTAACNQDAESQKFRWVSESQIMSVAFKLCLGVPSKTDWVAITLYACDSKSEFQKWECKNDTLLGIKGEDLFFNYGNRQEKNIMLYKGSGLWSRWKIYGTTDNLCSRGYEAMYTLLGNANGATCAFPFKFENKWYADCTSAGRSDGWLWCGTTTDYDTDKLFGYCPLKFEGSESLWNKDPLTSVSYQINSKSALTWHQARKSCQQQNAELLSITEIHEQTYLTGLTSSLTSGLWIGLNSLSFNSGWQWSDRSPFRYLNWLPGSPSAEPGKSCVSLNPGKNAKWENLECVQKLGYICKKGNTTLNSFVIPSESDVPTHCPSQWWPYAGHCYKIHRDEKKIQRDALTTCRKEGGDLTSIHTIEELDFIISQLGYEPNDELWIGLNDIKIQMYFEWSDGTPVTFTKWLRGEPSHENNRQEDCVVMKGKDGYWADRGCEWPLGYICKMKSRSQGPEIVEVEKGCRKGWKKHHFYCYMIGHTLSTFAEANQTCNNENAYLTTIEDRYEQAFLTSFVGLRPEKYFWTGLSDIQTKGTFQWTIEEEVRFTHWNSDMPGRKPGCVAMRTGIAGGLWDVLKCDEKAKFVCKHWAEGVTHPPKPTTTPEPKCPEDWGASSRTSLCFKLYAKGKHEKKTWFESRDFCRALGGDLASINNKEEQQTIWRLITASGSYHKLFWLGLTYGSPSEGFTWSDGSPVSYENWAYGEPNNYQNVEYCGELKGDPTMSWNDINCEHLNNWICQIQKGQTPKPEPTPAPQDNPPVTEDGWVIYKDYQYYFSKEKETMDNARAFCKRNFGDLVSIQSESEKKFLWKYVNRNDAQSAYFIGLLISLDKKFAWMDGSKVDYVSWATGEPNFANEDENCVTMYSNSGFWNDINCGYPNAFICQRHNSSINATTVMPTMPSVPSGCKEGWNFYSNKCFKIFGFMEEERKNWQEARKACIGFGGNLVSIQNEKEQAFLTYHMKDSTFSAWTGLNDVNSEHTFLWTDGRGVHYTNWGKGYPGGRRSSLSYEDADCVVIIGGASNEAGKWMDDTCDSKRGYICQTRSDPSLTNPPATIQTDGFVKYGKSSYSLMRQKFQWHEAETYCKLHNSLIASILDPYSNAFAWLQMETSNERVWIALNSNLTDNQYTWTDKWRVRYTNWAADEPKLKSACVYLDLDGYWKTAHCNESFYFLCKRSDEIPATEPPQLPGRCPESDHTAWIPFHGHCYYIESSYTRNWGQASLECLRMGSSLVSIESAAESSFLSYRVEPLKSKTNFWIGLFRNVEGTWLWINNSPVSFVNWNTGDPSGERNDCVALHASSGFWSNIHCSSYKGYICKRPKIIDAKPTHELLTTKADTRKMDPSKPSSNVA

SEQ ID NO: 2741 - protein, 1414 aa, synthetic construct
  REGION 1..1414: note = MRC2 (Q9UBG0) SP+PP+ECD
MGPGRPAPAPWPRHLLRCVLLLGCLHLGRPGAPGDAALPEPNVFLIFSHGLQGCLEAQGGQVRVTPACNTSLPAQRWKWVSRNRLFNLGTMQCLGTGWPGTNTTASLGMYECDREALNLRWHCRTLGDQLSLLLGARTSNISKPGTLERGDQTRSGQWRIYGSEEDLCALPYHEVYTIQGNSHGKPCTIPFKYDNQWFHGCTSTGREDGHLWCATTQDYGKDERWGFCPIKSNDCETFWDKDQLTDSCYQFNFQSTLSWREAWASCEQQGADLLSITEIHEQTYINGLLTGYSSTLWIGLNDLDTSGGWQWSDNSPLKYLNWESDQPDNPSEENCGVIRTESSGGWQNRDCSIALPYVCKKKPNATAEPTPPDRWANVKVECEPSWQPFQGHCYRLQAEKRSWQESKKACLRGGGDLVSIHSMAELEFITKQIKQEVEELWIGLNDLKLQMNFEWSDGSLVSFTHWHPFEPNNFRDSLEDCVTIWGPEGRWNDSPCNQSLPSICKKAGQLSQGAAEEDHGCRKGWTWHSPSCYWLGEDQVTYSEARRLCTDHGSQLVTITNRFEQAFVSSLIYNWEGEYFWTALQDLNSTGSFFWLSGDEVMYTHWNRDQPGYSRGGCVALATGSAMGLWEVKNCTSFRARYICRQSLGTPVTPELPGPDPTPSLTGSCPQGWASDTKLRYCYKVFSSERLQDKKSWVQAQGACQELGAQLLSLASYEEEHFVANMLNKIFGESEPEIHEQHWFWIGLNRRDPRGGQSWRWSDGVGFSYHNFDRSRHDDDDIRGCAVLDLASLQWVAMQCDTQLDWICKIPRGTDVREPDDSPQGRREWLRFQEAEYKFFEHHSTWAQAQRICTWFQAELTSVHSQAELDFLSHNLQKFSRAQEQHWWIGLHTSESDGRFRWTDGSIINFISWAPGKPRPVGKDKKCVYMTASREDWGDQRCLTALPYICKRSNVTKETQPPDLPTTALGGCPSDWIQFLNKCFQVQGQEPQSRVKWSEAQFSCEQQEAQLVTITNPLEQAFITASLPNVTFDLWIGLHASQRDFQWVEQEPLMYANWAPGEPSGPSPAPSGNKPTSCAVVLHSPSAHFTGRWDDRSCTEETHGFICQKGTDPSLSPSPAALPPAPGTELSYLNGTFRLLQKPLRWHDALLLCESRNASLAYVPDPYTQAFLTQAARGLRTPLWIGLAGEEGSRRYSWVSEEPLNYVGWQDGEPQQPGGCTYVDVDGAWRTTSCDTKLQGAVCGVSSGPPPPRRISYHGSCPQGLADSAWIPFREHCYSFHMELLLGHKEARQRCQRAGGAVLSILDEMENVFVWEHLQSYEGQSRGAWLGMNFNPKGGTLVWQDNTAVNYSNWGPPGLGPSMLSHNSCYWIQSNSGLWRPGACTNITMGVVCKLPRAEQSSFSPSALPENPAA

SEQ ID NO: 2742 - protein, 843 aa, synthetic construct; identical to SEQ ID NO: 1638
  REGION 1..843: note = MRVI1 (Q9Y6F6) SP+PP+ECD

SEQ ID NO: 2743 - protein, 638 aa, synthetic construct
  REGION 1..638: note = MSLNL (Q96KJ4) SP+PP+ECD
MAAAVTIPGPRIGALQSSGLTLLLSLAAHCSGPQAKVLSPGGLDASGANLWASANCSLLQGFWCQPASQLPRDQLSALIQRLALLQVPLQAWQLSCLANLASRCGLQDDFTLHPPNLLLFYNLSQVREADCRAFIRRAAQGDVELLSHLPDQRVALWRAAVACLVGAGLRLSASDQQLLGALVCDMDASSIGAADPHMLENLRRCPRLTAAQRIALNSLLAGGKTSLGPPGSWTLEGLQALGPLATYISPHLWAQVQEAVGLGFFRSVVASCQVGRLGQREARCFVTSFLESKTKPVSSRPRLSTGNITAATLRDDLFLVHYDCAELESCLDGCILRTNLDTLLQHLLPTECQHVVKAKLAQIYPQGLPEDQLRLITSLVYLYSRTEIGQWSITSQDTVMALLASDVALENQTEAVLQKFLEHNGTVSGALLLAIGGTRLCWMSPHQIQTIHPQELRLAGALDLSSCPQSRKDVLYTKAHETFGSSGTLAAYYRLMRPYLGGSPGGAQPPSPVPPGGAPVEELRHLAHANISMDIDTFTSLNPLELQSLDVGNVTALLGHNVGDLQKARSHPTVRAWLRSLNSSTLGQLGLDASPTSPTGPAHGTRGPPSTTHQVLHLVHTSGLPTNDAQASTSGSLW

SEQ ID NO: 2744 - protein, 957 aa, synthetic construct
  REGION 1..957: note = MST1R (Q04912) SP+PP+ECD
MELLPPLPQSFLLLLLLPAKPAAGEDWQCPRTPYAASRDFDVKYVVPSFSAGGLVQAMVTYEGDRNESAVFVAIRNRLHVLGPDLKSVQSLATGPAGDPGCQTCAACGPGPHGPPGDTDTKVLVLDPALPALVSCGSSLQGRCFLHDLEPQGTAVHLAAPACLFSAHHNRPDDCPDCVASPLGTRVTVVEQGQASYFYVASSLDAAVAASFSPRSVSIRRLKADASGFAPGFVALSVLPKHLVSYSIEYVHSFHTGAFVYFLTVQPASVTDDPSALHTRLARLSATEPELGDYRELVLDCRFAPKRRRRGAPEGGQPYPVLRVAHSAPVGAQLATELSIAEGQEVLFGVFVTGKDGGPGVGPNSVVCAFPIDLLDTLIDEGVERCCESPVHPGLRRGLDFFQSPSFCPNPPGLEALSPNTSCRHFPLLVSSSFSRVDLFNGLLGPVQVTALYVTRLDNVTVAHMGTMDGRILQVELVRSLNYLLYVSNFSLGDSGQPVQRDVSRLGDHLLFASGDQVFQVPIQGPGCRHFLTCGRCLRAWHFMGCGWCGNMCGQQKECPGSWQQDHCPPKLTEFHPHSGPLRGSTRLTLCGSNFYLHPSGLVPEGTHQVTVGQSPCRPLPKDSSKLRPVPRKDFVEEFECELEPLGTQAVGPTNVSLTVTNMPPGKHFRVDGTSVLRGFSFMEPVLIAVQPLFGPRAGGTCLTLEGQSLSVGTSRAVLVNGTECLLARVSEGQLLCATPPGATVASVPLSLQVGGAQVPGSWTFQYREDPVVLSISPNCGYINSHITICGQHLTSAWHLVLSFHDGLRAVESRCERQLPEQQLCRLPEYVVRDPQGWVAGNLSARGDGAAGFTLPGFRFLPPPHPPSANLVPLKPEEHAIKFEYIGLGAVADCVGINVTVGGESCQHEFRGDMVVCPLPPSLQLGQDGAPLQVCVDGECHILGRVVRPGPDGVPQST

SEQ ID NO: 2745 - protein, 1158 aa, synthetic construct
  REGION 1..1158: note = MUC1 (P15941) SP+PP+ECD
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPG

SEQ ID NO: 2746 - protein, 5380 aa, synthetic construct
  REGION 1..5380: note = MUC12 (Q9UKN1) SP+PP+ECD
MLVIWILTLALRLCASVTTVTPEGSAVHKAISQQGTLWTGEVLEKQTVEQGKSTLRRQKNHFHRSAGELRCRNALKDEGASAGWSVMFAGESVVVLVHLWMTGARVKNLGLVEFASPGDDGDGRAEGFSLGLPLSEQARAAGAREKERQETVINHSTFSGFSQITGSTVNTSIGGNTTSASTPSSSDPFTTFSDYGVSVTFITGSTATKHFLDSSTNSGHSEESTVSHSGPGATGTTLFPSHSATSVFVGEPKTSPITSASMETTALPGSTTTAGLSEKSTTFYSSPRSPDRTLSPARTTSSGVSEKSTTSHSRPGPTHTIAFPDSTTMPGVSQESTASHSIPGSTDTTLSPGTTTPSSLGPESTTFHSSPGYTKTTRLPDNTTTSGLLEASTPVHSSTGSPHTTLSPSSSTTHEGEPTTFQSWPSSKDTSPAPSGTTSAFVKLSTTYHSSPSSTPTTHFSASSTTLGHSEESTPVHSSPVATATTPPPARSATSGHVEESTAYHRSPGSTQTMHFPESSTTSGHSEESATFHGSTTHTKSSTPSTTAALAHTSYHSSLGSTETTHFRDSSTISGRSEESKASHSSPDAMATTVLPAGSTPSVLVGDSTPSPISSGSMETTALPGSTTKPGLSEKSTTFYSSPRSPDTTHLPASMTSSGVSEESTTSHSRPGSTHTTAFPGSTTMPGLSQESTASHSSPGPTDTTLSPGSTTASSLGPEYTTFHSRPGSTETTLLPDNTTASGLLEASMPVHSSTRSPHTTLSPAGSTTRQGESTTFHSWPSSKDTRPAPPTTTSAFVEPSTTSHGSPSSIPTTHISARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSERSTTFHSSPRSPATTLSPASTTSSGVSEESTTSRSRPGSTHTTAFPDSTTTPGLSRHSTTSHSSPGSTDTTLLPASTTTSGPSQESTTSHSSSGSTDTALSPGSTTALSFGQESTTFHSNPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSRGSTETTVFPHSTTTSVHGEEPTTFHSRPASTHTTLFTEDSTTSGLTEESTAFPGSPASTQTGLPATLTTADLGEESTTFPSSSGSTGTKLSPARSTTSGLVGESTPSRLSPSSTETTTLPGSPTTPSLSEKSTTFYTSPRSPDATLSPATTTSSGVSEESSTSHSQPGSTHTTAFPDSTTTSDLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPSSKDTMPAPPTTTSAFVELSTTSHGSPSSTPTTHFSASSTTLGRSEESTTVHSSPVATATTPSPARSTTSGLVEESTAYHSSPGSTQTMHFPESSTASGRSEESRTSHSSTTHTISSPPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRTPTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTTFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTASHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSGPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGSSQESTTSHSSSGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRREEPTTFHSRPASTHTTLFTEDSTTSGLTEESTAFPGSPASTQTGLPATLTTADLGEESTTFPSSSGSTGTKLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSTGLQEESTTFQSWPSSSDTTPSPPSTTAVPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSMHTTAFPSSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESNTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPSSTPTTHFSASSTTLGRSEESTTVHSSPVATATTPSPARSTTSGLVEESTAYHSSPGSTQTMHFPESSTASGRSEESRTSHSSTTHTISSPPSTTSALVEEPTSYHSSPGSIATTHFPESSTTSGRSEESTASHSSPDTNGITPLPAHFTTSGRIAESTTFYISPGSMETTLASTATTPGLSAKSTILYSSSRSPDQTLSPASMTSSSISGEPTSLYSQAESTHTTAFPASTTTSGLSQESTTFHSKPGSTETTLSPGSITTSSFAQEFTTPHSQPGSALSTVSPASTTVPGLSEESTTFYSSPGSTETTAFSHSNTMSIHSQQSTPFPDSPGFTHTVLPATLTTTDIGQESTAFHSSSDATGTTPLPARSTASDLVGEPTTFYISPSPTYTTLFPASSSTSGLTEESTTFHTSPSFTSTIVSTESLETLAPGLCQEGQIWNGKQCVCPQGYVGYQCLSPLESFPVETPEKLNATLGMTVKVTYRNFTEKMNDASSQEYQNFSTLFKNRMDVVLKGDNLPQYRGVNIRRLLNGSIVVKNDVILEADYTLEYEELFENLAEIVKAKIMNETRTTLLDPDSCRKAILCYSEEDTFVDSSVTPGFDFQEQCTQKAAEGYTQFYYVDVLDGKLACVNKCTKGTKSQMNCNLGTCQLQRSGPRCLCPNTNTHWYWGETCEFNIAKSLVY

SEQ ID NO: 2747 - protein, 421 aa, synthetic construct
  REGION 1..421: note = MUC13 (Q9H3R2) SP+PP+ECD
MKAIIHLTLLALLSVNTATNQGNSADAVTTTETATSGPTVAAADTTETNFPETASTTANTPSFPTATSPAPPIISTHSSSTIPTPAPPIISTHSSSTIPIPTAADSESTTNVNSLATSDIITASSPNDGLITMVPSETQSNNEMSPTTEDNQSSGPPTGTALLETSTLNSTGPSNPCQDDPCADNSLCVKLHNTSFCLCLEGYYYNSSTCKKGKVFPGKISVTVSETFDPEEKHSMAYQDLHSEITSLFKDVFGTSVYGQTVILTVSTSLSPRSEMRADDKFVNVTIVTILAETTSDNEKTVTEKINKAIRSSSSNFLNYDLTLRCDYYGCNQTADDCLNGLACDCKSDLQRPNPQSPFCVASSLKCPDACNAQHKQCLIKKSGGAPECACVPGYQEDANGNCQKCAFGYSGLDCKDKFQL

SEQ ID NO: 2748 - protein, 236 aa, synthetic construct
  REGION 1..236: note = MUC15 (Q8N387) SP+PP+ECD
MLALAKILLISTLFYSLLSGSHGKENQDINTTQNIAEVFKTMENKPISLESEANLNSDKENITTSNLKASHSPPLNLPNNSHGITDFSSNSSAEHSLGSLKPTSTISTSPPLIHSFVSKVPWNAPIADEDLLPISAHPNATPALSSENFTWSLVNDTVKTPDNSSITVSILSSEPTSPSVTPLIVEPSGWLTTNSDSFTGFTPYQEKTTLQPTLKFTNNSKLFPNTSDPQKENRNT

SEQ ID NO: 2749 - protein, 4393 aa, synthetic construct
  REGION 1..4393: note = MUC17 (Q685J3) SP+PP+ECD
MPRPGTMALCLLTLVLSLLPPQAAAEQDLSVNRAVWDGGGCISQGDVLNRQCQQLSQHVRTGSAANTATGTTSTNVVEPRMYLSCSTNPEMTSIESSVTSDTPGVSSTRMTPTESRTTSESTSDSTTLFPSSTEDTSSPTTPEGTDVPMSTPSEESISSTMAFVSTAPLPSFEAYTSLTYKVDMSTPLTTSTQASSSPTTPESTTIPKSTNSEGSTPLTSMPASTMKVASSEAITLLTTPVEISTPVTISAQASSSPTTAEGPSLSNSAPSGGSTPLTRMPLSVMLVVSSEASTLSTTPAATNIPVITSTEASSSPTTAEGTSIPTSTYTEGSTPLTSTPASTMPVATSEMSTLSITPVDTSTLVTTSTEPSSLPTTAEATSMLTSTLSEGSTPLTNMPVSTILVASSEASTTSTIPVDSKTFVTTASEASSSPTTAEDTSIATSTPSEGSTPLTSMPVSTTPVASSEASNLSTTPVDSKTQVTTSTEASSSPPTAEVNSMPTSTPSEGSTPLTSMSVSTMPVASSEASTLSTTPVDTSTPVTTSSEASSSSTTPEGTSIPTSTPSEGSTPLTNMPVSTRLVVSSEASTTSTTPADSNTFVTTSSEASSSSTTAEGTSMPTSTYSERGTTITSMSVSTTLVASSEASTLSTTPVDSNTPVTTSTEATSSSTTAEGTSMPTSTYTEGSTPLTSMPVNTTLVASSEASTLSTTPVDTSTPVTTSTEASSSPTTADGASMPTSTPSEGSTPLTSMPVSKTLLTSSEASTLSTTPLDTSTHITTSTEASCSPTTTEGTSMPISTPSEGSPLLTSIPVSITPVTSPEASTLSTTPVDSNSPVTTSTEVSSSPTPAEGTSMPTSTYSEGRTPLTSMPVSTTLVATSAISTLSTTPVDTSTPVTNSTEARSSPTTSEGTSMPTSTPGEGSTPLTSMPDSTTPVVSSEARTLSATPVDTSTPVTTSTEATSSPTTAEGTSIPTSTPSEGTTPLTSTPVSHTLVANSEASTLSTTPVDSNTPLTTSTEASSPPPTAEGTSMPTSTPSEGSTPLTRMPVSTTMVASSETSTLSTTPADTSTPVTTYSQASSSSTTADGTSMPTSTYSEGSTPLTSVPVSTRLVVSSEASTLSTTPVDTSIPVTTSTEASSSPTTAEGTSIPTSPPSEGTTPLASMPVSTTLVVSSEANTLSTTPVDSKTQVATSTEASSPPPTAEVTSMPTSTPGERSTPLTSMPVRHTPVASSEASTLSTSPVDTSTPVTTSAETSSSPTTAEGTSLPTSTTSEGSTLLTSIPVSTTLVTSPEASTLLTTPVDTKGPVVTSNEVSSSPTPAEGTSMPTSTYSEGRTPLTSIPVNTTLVASSAISILSTTPVDNSTPVTTSTEACSSPTTSEGTSMPNSNPSEGTTPLTSIPVSTTPVVSSEASTLSATPVDTSTPGTTSAEATSSPTTAEGISIPTSTPSEGKTPLKSIPVSNTPVANSEASTLSTTPVDSNSPVVTSTAVSSSPTPAEGTSIAISTPSEGSTALTSIPVSTTTVASSEINSLSTTPAVTSTPVTTYSQASSSPTTADGTSMQTSTYSEGSTPLTSLPVSTMLVVSSEANTLSTTPIDSKTQVTASTEASSSTTAEGSSMTISTPSEGSPLLTSIPVSTTPVASPEASTLSTTPVDSNSPVITSTEVSSSPTPAEGTSMPTSTYTEGRTPLTSITVRTTPVASSAISTLSTTPVDNSTPVTTSTEARSSPTTSEGTSMPNSTPSEGTTPLTSIPVSTTPVLSSEASTLSATPIDTSTPVTTSTEATSSPTTAEGTSIPTSTLSEGMTPLTSTPVSHTLVANSEASTLSTTPVDSNSPVVTSTAVSSSPTPAEGTSIATSTPSEGSTALTSIPVSTTTVASSETNTLSTTPAVTSTPVTTYAQVSSSPTTADGSSMPTSTPREGRPPLTSIPVSTTTVASSEINTLSTTLADTRTPVTTYSQASSSPTTADGTSMPTPAYSEGSTPLTSMPLSTTLVVSSEASTLSTTPVDTSTPATTSTEGSSSPTTAGGTSIQTSTPSERTTPLAGMPVSTTLVVSSEGNTLSTTPVDSKTQVTNSTEASSSATAEGSSMTISAPSEGSPLLTSIPLSTTPVASPEASTLSTTPVDSNSPVITSTEVSSSPIPTEGTSMQTSTYSDRRTPLTSMPVSTTVVASSAISTLSTTPVDTSTPVTNSTEARSSPTTSEGTSMPTSTPSEGSTPFTSMPVSTMPVVTSEASTLSATPVDTSTPVTTSTEATSSPTTAEGTSIPTSTLSEGTTPLTSIPVSHTLVANSEVSTLSTTPVDSNTPFTTSTEASSPPPTAEGTSMPTSTSSEGNTPLTRMPVSTTMVASFETSTLSTTPADTSTPVTTYSQAGSSPTTADDTSMPTSTYSEGSTPLTSVPVSTMPVVSSEASTHSTTPVDTSTPVTTSTEASSSPTTAEGTSIPTSPPSEGTTPLASMPVSTTPVVSSEAGTLSTTPVDTSTPMTTSTEASSSPTTAEDIVVPISTASEGSTLLTSIPVSTTPVASPEASTLSTTPVDSNSPVVTSTEISSSATSAEGTSMPTSTYSEGSTPLRSMPVSTKPLASSEASTLSTTPVDTSIPVTTSTETSSSPTTAKDTSMPISTPSEVSTSLTSILVSTMPVASSEASTLSTTPVDTRTLVTTSTGTSSSPTTAEGSSMPTSTPGERSTPLTNILVSTTLLANSEASTLSTTPVDTSTPVTTSAEASSSPTTAEGTSMRISTPSDGSTPLTSILVSTLPVASSEASTVSTTAVDTSIPVTTSTEASSSPTTAEVTSMPTSTPSETSTPLTSMPVNHTPVASSEAGTLSTTPVDTSTPVTTSTKASSSPTTAEGIVVPISTASEGSTLLTSIPVSTTPVASSEASTLSTTPVDTSIPVTTSTEGSSSPTTAEGTSMPISTPSEVSTPLTSILVSTVPVAGSEASTLSTTPVDTRTPVTTSAEASSSPTTAEGTSMPISTPGERRTPLTSMSVSTMPVASSEASTLSRTPADTSTPVTTSTEASSSPTTAEGTGIPISTPSEGSTPLTSIPVSTTPVAIPEASTLSTTPVDSNSPVVTSTEVSSSPTPAEGTSMPISTYSEGSTPLTGVPVSTTPVTSSAISTLSTTPVDTSTPVTTSTEAHSSPTTSEGTSMPTSTPSEGSTPLTYMPVSTMLVVSSEDSTLSATPVDTSTPVTTSTEATSSTTAEGTSIPTSTPSEGMTPLTSVPVSNTPVASSEASILSTTPVDSNTPLTTSTEASSSPPTAEGTSMPTSTPSEGSTPLTSMPVSTTTVASSETSTLSTTPADTSTPVTTYSQASSSPPIADGTSMPTSTYSEGSTPLTNMSFSTTPVVSSEASTLSTTPVDTSTPVTTSTEASLSPTTAEGTSIPTSSPSEGTTPLASMPVSTTPVVSSEVNTLSTTPVDSNTLVTTSTEASSSPTIAEGTSLPTSTTSEGSTPLSIMPLSTTPVASSEASTLSTTPVDTSTPVTTSSPTNSSPTTAEVTSMPTSTAGEGSTPLTNMPVSTTPVASSEASTLSTTPVDSNTFVTSSSQASSSPATLQVTTMRMSTPSEGSSSLTTMLLSSTYVTSSEASTPSTPSVDRSTPVTTSTQSNSTPTPPEVITLPMSTPSEVSTPLTIMPVSTTSVTISEAGTASTLPVDTSTPVITSTQVSSSPVTPEGTTMPIWTPSEGSTPLTTMPVSTTRVTSSEGSTLSTPSVVTSTPVTTSTEAISSSATLDSTTMSVSMPMEISTLGTTILVSTTPVTRFPESSTPSIPSVYTSMSMTTASEGSSSPTTLEGTTTMPMSTTSERSTLLTTVLISPISVMSPSEASTLSTPPGDTSTPLLTSTKAGSFSIPAEVTTIRISITSERSTPLTTLLVSTTLPTSFPGASIASTPPLDTSTTFTPSTDTASTPTIPVATTISVSVITEGSTPGTTIFIPSTPVTSSTADVFPATTGAVSTPVITSTELNTPSTSSSSTTTSFSTTKEFTTPAMTTAAPLTYVTMSTAPSTPRTTSRGCTTSASTLSATSTPHTSTSVTTRPVTPSSESSRPSTITSHTIPPTFPPAHSSTPPTTSASSTTVNPEAVTTMTTRTKPSTRTTSFPTVTTTAVPTNTTIKSNPTSTPTVPRTTTCFGDGCQNTASRCKNGGTWDGLKCQCPNLYYGELCEEVVSSIDIGPPETISAQMELTVTVTSVKFTEELKNHSSQEFQEFKQTFTEQMNIVYSGIPEYVGVNITKLRLGSVVVEHDVLLRTKYTPEYKTVLDNATEVVKEKITKVTTQQIMINDICSDMMCFNTTGTQVQNITVTQYDPEEDCRKMAKEYGDYFVVEYRDQKPYCISPCEPGFSVSKNCNLGKCQMSLSGPQCLCVTTETHWYSGETCNQGTQKSLVYG

SEQ ID NO: 2750 - protein, 479 aa, synthetic construct
  REGION 1..479: note = MUC21 (Q5SSG8) SP+PP+ECD
MKMQKGNVLLMFGLLLHLEAATNSNETSTSANTGSSVISSGASTATNSGSSVTSSGVSTATISGSSVTSNGVSIVTNSEFHTTSSGISTATNSEFSTVSSGISIATNSESSTTSSGASTATNSESSTPSSGASTATNSDSSTTSSGASTATNSDSSTTSSEASTATNSESSTTSSGASTATNSESSTVSSRASTATNSESSTTSSGASTATNSESRTTSNGAGTATNSESSTTSSGASTATNSESSTPSSGAGTATNSESSTTSSGAGTATNSESSTVSSGISTVTNSESSTPSSGANTATNSESSTTSSGANTATNSDSSTTSSGASTATNSESSTTSSGASTATNSESSTTSSGASTATNSGSSTTSSGTSTATNSESSTVSSGASTATTSESSTTSSGASTATNSESSTVSSGASTATNSESSTTSSGANTATNSGSSVTSAGSGTAALTGMHTTSHSASTAVSEAKPGGSLVPWE

SEQ ID NO: 2751 - protein, 1660 aa, synthetic construct
  REGION 1..1660: note = MUC22 (E2RYF6) SP+PP+ECD
MRRGNISPAFWFLWLLLFGLLGPSSENTTAFTKGSDTTTASITGSETTMASTMASTSALTTGSKITTDSTTGSETTSASTMASTAAFTTGSETNTASTTDSGTTIASTRTFTTGSDTTTGSTAGSETIVASTTVSGTTTTFTIASTTVPETTMASSTTSTAGSEKTMASSIISETTMASTTGSETATVSTTGSETTTTSTASSEATKVSTTGSETTTASTAGSETTTTSTSMAGSEATTTSTADSKVITASSMSSETTVAPAAGSNTTTASTTGSETTTILIKASETTTASTAGSETTTPSPTGSQTTIVSISGSEITTTSTAGSENTTVSSAGSGTTTASMAGSETTVSTAGSETTTVSITGTETTMVSAMGSETTTNSTTSSETTVTSTAGSETTTVSTVGSETTTAYTADSETTAASTTGSEMTTVFTAGSETITPSTAGSETTTVSTAGSETTTVSTTGSETTTASTAHSETTAASTMGSETTKVSTAGSETTVSTAGSETTAASTEDSETNTAFTEDSKTTTASTTGFETTAASTTGSEPTMASTMGSETTMASTIGPETTKVSTASSEVTTVFAAGSETIRASTVGSETTTVSTTGSETTTASIMGSETSTDSTTGSETTTASTEGSETTTASTEGSEATTVSTTGSETTTVSITDSETTTTCTEGSEMTAVSTTVFETTTASTEGSEITIASTSDSETTTASTEGSETTTVTTAGSETKTAYTTGSETTTASNTGLETTTVFTIGSDTTTASTEGSETTAVSATGSEMTTVSTEGSENTTVSTTGSETTTVSTTGLETTTTSTEGSEMTTVSTTGAETTTDSTEGSGTTAASTAGSETTTVSTADSENTTASTADSETTSASTTGSETTTASTTSSETTTASTEGSETTTVSTTDSETTMVSTTGSERTITSTEGSETTTVSATGSETTVSTEGSGTTTVSITGSETTKVSTTGSETTTTSTEGSEITTASITGSETTTASTEGSETTTASTEGSETTSASTTGSETTTASTTSSETTMASIMGSETTMASTIGSETTKVSTASSKMTTVFTENSETTIASTTASETTTVSTAGSETIPASTAGSETTTTTSTEGSETTTASTEGSETTTASTESSETTTATTIGSETTTASTEGSETTTTSTEGSETTTASTEGSEITTVSTTGSETTTASTEGSETTTASTEGSELTTVSTTGSETITVSAEGSETTTVTTMGSETTTASTAGSETTTVSTAGSETTTASIEGSETTTVSSTGSETTTVSTTGTETTITSTEGSETTTVTTAGSETTAVYTTGSETTTTSTEGSETTTVSTTGSETTTASTADLETTTVSTSGSGTTTASTAGSETTTVYITGSKTTTASTEGSEATTVSTTSSETTTASTTGSEMTTVFTTVSETTTVSTIGSEATTSSAAGSEATTTSTEGSETTTASTAGSETTTASTAGSETTTASTSGSETNTACTTGSETSTPSSAGSETNTAFIIGSESTIASTASLEPTATSLTGSETTTVSITASGATAASTTVSSTTFVLTKATDVSIQPITNTPMSGTRTTGTRLTASSSVTMAPGMDFTASAASHTVPGIVLNTSGLGTSTMGASSTTSAHGVRTTTGSTREPTSSTFQETGPVSMGTNTVSMSHTPTNVIKPSGYLQP

SEQ ID NO: 2752 - protein, 3226 aa, synthetic construct
  REGION 1..3226: note = MUC3A (Q02505) SP+PP+ECD
MQLLGLLGLLWMLKASPWATGTLSTATSISQVPFPRAEAASAVLSNSPHSRDLAGWPLGVPQLASPAPGHRENAPMTLTTSPHDTLISETLLNSPVSSNTSTTPTSKFAFKVETTPPTVLVYSATTECVYPTSFIITISHPTSICVTTTQVAFTSSYTSTPVTQKPVTTVTSTYSMTTTEKGTSAMTSSPSTTTARETPIVTVTPSSVSATDTTFHTTISSTTRTTERTPLPTGSIHTTTSPTPVFTTLKTAVTSTSPITSSITSTNTVTSMTTTASQPTATNTLSSPTRTILSSTPVLSTETITSGITNTTPLSTLVTTLPTTISRSTPTSETTYTTSPTSTVTDSTTKIAYSTSMTGTLSTETSLPPTSSSLPTTETATTPMTNLVTTTTEISSHSTPSFSSSTIYSTVSTSTTAISSLPPTSGTMVTSTTMTPSSLSTDIPFTTPTTITHHSVGSTGFLTTATDLTSTFTVSSSSAMSTSVIPSSPSIQNTETSSLVSMTSATTPNVRPTFVSTLSTPTSSLLTTFPATYSFSSSMSASSAGTTHTESISSPPASTSTLHTTAESTLAPTTTTSFTTSTTMEPPSTTAATTGTGQTTFTSSTATFPETTTPTPTTDMSTESLTTAMTSPPITSSVTSTNTVTSMTTTTSPPTTTNSFTSLTSMPLSSTPVPSTEVVTSGTINTIPPSILVTTLPTPNASSMTTSETTYPNSPTGPGTNSTTEITYPTTMTETSSTATSLPPTSPLVSTAKTAKTPTTNLVTTTTKTTSHSTTSFTSSTVYSTASTYTTAITSVPTTLGTMVTSTSMISSTVSTGIPTSQPTTITPSSVGISGSLPMMTDLTSVYTVSNMSARPTTVIPSSPTVQNTEISISVSMTSATTPSGGPTFTSTENTPTRSLLTSFPMTHSFSSSMSESSAGTTHTESISSPRGTTSTLHTTVESTPSPTTTTSFTTSTMMEPPSSTVSTTGRGQTTFPSSTATFPETTTLTPTTDISTVSLTTAMTSPPPVSSSITPTNTMTSMRTTTYWPTATNTLSPLTSSILSSTPVPSTEMITSHTTNTTPLSTLVTTLLTTITRSTPTSETTYPTSPTSIVSDSTTEITYSTSITGTLSTATTLPPTSSSLPTTETATMTPTTTLITTTPNTTSLSTPSFTSSTIYSTVSTSTTAISSASPTSGTMVTSTTMTPSSLSTDTPSTTPTTITYPSVGSTGFLTTATDLTSTFTVSSSSAMSTSVIPSSPSIQNTETSSLVSMTSATTPSLRPTITSTDSTLTSSLLTTFPSTYSFSSSMSASSAGTTHTETISSLPASTNTIHTTAESALAPTTTTSFTTSPTMEPPSTTVATTGTGQTTFPSSTATFLETTTLTPTTDFSTESLTTAMTSTPPITSSITPTDTMTSMRTTTSWPTATNTLSPLTSSILSSTPVPSTEVTTSHTTNTNPVSTLVTTLPITITRSTLTSETAYPSSPTSTVTESTTEITYPTTMTETSSTATSLPPTSSLVSTAETAKTPTTNLVTTTTKTTSHSTTSFTSSTIYSTASTPTTAITSVPTTLGTMVTSTSMIPSTVSTGIPTSQPTTITPSSVGISGSLPMMTDLTSVYTVSSMSARPTSVIPSSPTVQNTETSIFVSMMSATTPSGGPTFTSTENTPTRSLLTSFPVTHSFSSSMSASSVGTTHTQSISSPPAITSTLHTTAESTPSPTTTMSFTTFTKMETPSSTVATTGTGQTTFTSSTATSPKTTTLTPTSDISTGSFKTAVSSTPPITSSITSTYTVTSMTTTTPLGPTATNTLPSFTSSVSSSTPVPSTEAITSGTTNTTPLSTLVTTFSNSDTSSTPTSETTYPTSLTSALTDSTTRTTYSTNMTGTLSTVTSLRPTSSSLLTTVTATVPTTNLVTTTTKITSHSTPSFTSSIATTETPSHSTPRFTSSITTTETPSHSTPRFTSSITNTKTTSHSSPSFTSSITTTETTSHNTPSLTSSITTTKTTSHSTPSYTSLITTTTTTSHSTPSFTSSITTTETTSHNTPSLTSSITTTETTSHSTPSFTSSITTETTSHSTPSFTSLITITEITSHSTLSYTTSITTTETPSHSTLSFTSSITTTETTSHSTPSFTSSITTSEMPSHSTPSFTSSITTTENATHSTPNFTSSITTTETTSHSTPSFTSLITTTETTSHRWGTTETTSYSTPSFTSSNTITETTSHSTPSYITSITTTETPSSSTPSFSSSITTTETTSHSTPGFTSSITTTETTSHSTPSFTSSITTTETTSHDTPSFTSSITTSETPSHSTPSSTSLITTTKTTSHSTPSFTSSITTTETTSHSAHSFTSSITTTETTSHNTRSFTSSITTTETNSHSTTSFTSSITTTETTSHSTPSFSSSITTTETPLHSTPGLTSWVTTTKTTSHITPGLTSSITTTETTSHSTPGFTSSITTTETTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHTLTPSTALSTIVSTSQVPIPSTHSSTLQTTPSTPSLQTSLTSTSEFTTESFTRGSTSTNAILTSFSTIIWSSTPTIIMSSSPSSASITPVFSTTIHSVPSSPYIFSTENVGSASITGFPSLSSSATTSTSSTSSSLTTALTEITPFSYISLPSTTPCPGTITITIVPASPTDPCVEMDPSTEATSPPTTPLTVFPFTTEMVTCPTSISIQTTLTTYMDTSSMMPESESSISPNASSSTGTGTVPTNTVFTSTRLPTSETWLSNSSVIPLPLPGVSTIPLTMKPSSSLPTILRTSSKSTHPSPPTTRTSETPVATTQTPTTLTSRRTTRITSQMTTQSTLTTTAGTCDNGGTWEQGQCACLPGFSGDRCQLQTRCQNGGQWDGLKCQCPSTFYGSSCEFAVEQVDLDVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDVNSCQDSQTLCFKPDSIKVNNNSKTELTPAAICRRAAPTGYEEFYFPLVEATRLRCVTKCTSGVDNAIDCHQGQCVLETSGPTCRCYSTDTHWFSGPRCEVAVHWRA

SEQ ID NO: 2753 - protein, 1140 aa, synthetic construct
  REGION 1..1140: note = MUC3B (Q9H195) SP+PP+ECD
MQLLGLLSILWMLKSSPGATGTLSTATSTSHVTFPRAEATRTALSNSPHSRYLAEWPQGVPQLASPAPGHRENAPMTLTTSPHDTLISETLLSSLVSSNTSTTPTSKFAFKVETTPPTVLVYSATTECVYPTSFIITISHSTSICVTTTQVTFTSSYTPTPVTQKPVTTVTRTYPMTTTEKGTSAMISSPSTTTARETPIVTVTPSSSVSATDTTFHTTISSTTRTTERTPLPTGSIHTTMSPTPVFTTLKTAVTSTSPITSTITSTNTVTSMTTTTSRPTATNTLSSLTSSILSSTPAPNTEVITSHTTTTTPPSTLVTTLPTAIARSTPTSETTPSFMSSIITTETTSHSTPSFSSSTIHSTVSSSTTAITSPFTTAETGVTSTPSSPSSLSTDIPTTSLRTLTPLSLSTSTSLTTTTDLPSIPTDISSLPTPIHIISSSPSIQSTETSSLVGTTSPTMSTVRATLRSTENTPISSFSTSIVVTPETPTTQAPPVLMSATGTQTSPVPTTVTFGSMDSSTSTLHTLTPSTALSKIMSTSQFPIPSTHSSTLQTTPSIPSLQTSLTSTSEFTTESFTRGSTSTNAILTSFSTIIWSSTPTIIMSSSPSSASITPVFATTIHSVPSSPYIFSTENVGSASITAFPSLSSSSTTSTSPTSSSLTTALTEITPFSYISLPSTTPCPGTITITIVPASPTDPCVEMDPSTEATSPPTTPLTVFPFTTEMVTCPSSISMQTTLATHMDTSSMTPESESSIIPNASSSTGTGTVPTNTVFTSTRLPTSETWLSNNSVIPTPLPGVSTIPLTMKPSSSLPTILRTSSKSTHPSPPTARTSQTSVATTQTPTTLTTCRTTPITSWMTTQSTLTTTAGTCDNGGTWEQGQCACLPGFSGDRCQLQTRCQNGGQWDGLKCQCPSTFYGSSCEFAVEQVDLDVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDANSCQDSQALCFKPDSIKVNNNSKTELTPEAICRRAAPTGYEEFYFPLVEATRLRCVTKCTSGLDNAIDCHQGQCVLETSGPACRCYSTDTHWFSGPRCEVTVHWRA

SEQ ID NO: 2754 - protein, 2125 aa, synthetic construct
  REGION 1..2125: note = MUC4 (Q99102) SP+PP+ECD
MKGARWRRVPWVSLSCLCLCLLPHVVPGTTEDTLITGSKTAAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTRAAGTIPRVPSKVSAIGEPGEPTTYSSHSTTLPKTTGAGAQTQWTQETGTTGEALLSSPSYSVIQMIKTATSPSSSPMLDRHTSQQITTAPSTNHSTIHSTSTSPQESPAVSQRGHTRAPQTTQESQTTRSVSPMTDTKTVTTPGSSFTASGHSPSEIVPQDAPTISAATTFAPAPTGNGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTGTSRGSDTISLASQATDTFSTVPPTPPSITSSGLTSPQTQTHTLSPSGSGKTFTTALISNATPLPVTSTSSASTGHATPLAVSSATSASTVSSDSPLKMETSGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKMTNNGGYKARWALKVTWVNAHAYPAQWTLGSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDA

SEQ ID NO: 2755 - protein, 495 aa, synthetic construct
  REGION 1..495: note = MUSK (O15146) SP+PP+ECD
MRELVNIPLVHILTLVAFSGTEKLPKAPVITTPLETVDALVEEVATFMCAVESYPQPEISWTRNKILIKLFDTRYSIRENGQLLTILSVEDSDDGIYCCTANNGVGGAVESCGALQVKMKPKITRPPINVKIIEGLKAVLPCTTMGNPKPSVSWIKGDSPLRENSRIAVLESGSLRIHNVQKEDAGQYRCVAKNSLGTAYSKVVKLEVEVFARILRAPESHNVTFGSFVTLHCTATGIPVPTITWIENGNAVSSGSIQESVKDRVIDSRLQLFITKPGLYTCIATNKHGEKFSTAKAAATISIAEWSKPQKDNKGYCAQYRGEVCNAVLAKDALVFLNTSYADPEEAQELLVHTAWNELKVVSPVCRPAAEALLCNHIFQECSPGVVPTPIPICREYCLAVKELFCAKEWLVMEEKTHRGLYRSEMHLLSVPECSKLPSMHWDPTACARLPHLDYNKENLKTFPPMTSSKPSVDIPNLPSSSSSSFSVSPTYSMT

SEQ ID NO: 2756 - protein, 341 aa, synthetic construct
  REGION 1..341: note = MXRA8 (Q9BRK3) SP+PP+ECD
MALPSRILLWKLVLLQSSAVLLHSGSSVPAAAGSSVVSESAVSWEAGARAVLRCQSPRMVWTQDRLHDRQRVLHWDLRGPGGGPARRLLDLYSAGEQRVYEARDRGRLELSASAFDDGNFSLLIRAVEETDAGLYTCNLHHHYCHLYESLAVRLEVTDGPPATPAYWDGEKEVLAVARGAPALLTCVNRGHVWTDRHVEEAQQVVHWDRQPPGVPHDRADRLLDLYASGERRAYGPLFLRDRVAVGADAFERGDFSLRIEPLEVADEGTYSCHLHHHYCGLHERRVFHLTVAEPHAEPPPRGSPGNGSSHSGAPGPDPTLARGHNVINVIVPESRAHFFQQ

SEQ ID NO: 2757 - protein, 448 aa, synthetic construct
  REGION 1..448: note = NAGPA (Q9UK23) SP+PP+ECD
MATSTGRWLLLRLALFGFLWEASGGLDSGASRDDDLLLPYPRARARLPRDCTRVRAGNREHESWPPPPATPGAGGLAVRTFVSHFRDRAVAGHLTRAVEPLRTFSVLEPGGPGGCAARRRATVEETARAADCRVAQNGGFFRMNSGECLGNVVSDERRVSSSGGLQNAQFGIRRDGTLVTGYLSEEEVLDTENPFVQLLSGVVWLIRNGSIYINESQATECDETQETGSFSKFVNVISARTAIGHDRKGQLVLFHADGQTEQRGINLWEMAEFLLKQDVVNAINLDGGGSATFVLNGTLASYPSDHCQDNMWRCPRQVSTVVCVHEPRCQPPDCHGHGTCVDGHCQCTGHFWRGPGCDELDCGPSNCSQHGLCTETGCRCDAGWTGSNCSEECPLGWHGPGCQRPCKCEHHCPCDPKTGNCSVSRVKQCLQPPEATLRAGELSFFTRT

SEQ ID NO: 2758 - protein, 718 aa, synthetic construct
  REGION 1..718: note = NCAM1 (P13591) SP+PP+ECD
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKASWTRPEKQETLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSG

SEQ ID NO: 2759 - protein, 697 aa, synthetic construct
  REGION 1..697: note = NCAM2 (O15394) SP+PP+ECD
MSLLLSFYLLGLLVSSGQALLQVTISLSKVELSVGESKFFTCTAIGEPESIDWYNPQGEKIISTQRVVVQKEGVRSRLTIYNANIEDAGIYRCQATDAKGQTQEATVVLEIYQKLTFREVVSPQEFKQGEDAEVVCRVSSSPAPAVSWLYHNEEVTTISDNRFAMLANNNLQILNINKSDEGIYRCEGRVEARGEIDFRDIIVIVNVPPAISMPQKSFNATAERGEEMTFSCRASGSPEPAISWFRNGKLIEENEKYILKGSNTELTVRNIINSDGGPYVCRATNKAGEDEKQAFLQVFVQPHIIQLKNETTYENGQVTLVCDAEGEPIPEITWKRAVDGFTFTEGDKSLDGRIEVKGQHGSSSLHIKDVKLSDSGRYDCEAASRIGGHQKSMYLDIEYAPKFISNQTIYYSWEGNPINISCDVKSNPPASIHWRRDKLVLPAKNTTNLKTYSTGRKMILEIAPTSDNDFGRYNCTATNHIGTRFQEYILALADVPSSPYGVKIIELSQTTAKVSFNKPDSHGGVPIHHYQVDVKEVASEIWKIVRSHGVQTMVVLNNLEPNTTYEIRVAAVNGKGQGDYSKIEIFQTLPVREPSPPSIHGQPSSGKSFKLSITKQDDGGAPILEYIVKYRSKDKEDQWLEKKVQGNKDHIILEHLQWTMGYEVQITAANRLGYSEPTVYEFSMPPKPNIIKDTLFN

SEQ ID NO: 2760 - protein, 258 aa, synthetic construct
  REGION 1..258: note = NCR1 (O76036) SP+PP+ECD
MSSTLPALLCVGLCLSQRISAQQQTLPKPFIWAEPHFMVPKEKQVTICCQGNYGAVEYQLHFEGSLFAVDRPKPPERINKVKFYIPDMNSRMAGQYSCIYRVGELWSEPSNLLDLVVTEMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPADTWGTYLLTTETGLQKDHALWDHTAQNLLR

SEQ ID NO: 2761 - protein, 192 aa, synthetic construct
  REGION 1..192: note = NCR2 (O95944) SP+PP+ECD
MAWRALHPLLLLLLLFPGSQAQSKAQVLQSVAGQTLTVRCQYPPTGSLYEKKGWCKEASALVCIRLVTSSKPRTMAWTSRFTIWDDPDAGFFTVTMTDLREEDSGHYWCRIYRPSDNSVSKSVRFYLVVSPASASTQTSWTPRDLVSSQTQTQSCVPPTAGARQAPESPSTIPVPSQPQNSTLRPGPAAPIA

SEQ ID NO: 2762 - protein, 135 aa, synthetic construct
  REGION 1..135: note = NCR3 (O14931) SP+PP+ECD
MAWMLLLILIMVHPGSCALWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLG

SEQ ID NO: 2763 - protein, 262 aa, synthetic construct
  REGION 1..262: note = NCR3LG1 (Q68D85) SP+PP+ECD
MTWRAAASTCAALLILLWALTTEGDLKVEMMAGGTQITPLNDNVTIFCNIFYSQPLNITSMGITWFWKSLTFDKEVKVFEFFGDHQEAFRPGAIVSPWRLKSGDASLRLPGIQLEEAGEYRCEVVVTPLKAQGTVQLEVVASPASRLLLDQVGMKENEDKYMCESSGFYPEAINITWEKQTQKFPHPIEISEDVITGPTIKNMDGTFNVTSCLKLNSSQEDPGTVYQCVVRHASLHTPLRSNFTLTAARHSLSETEKTDNFS

SEQ ID NO: 2764 - protein, 669 aa, synthetic construct
  REGION 1..669: note = NCSTN (Q92542) SP+PP+ECD
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELE

SEQ ID NO: 2765 - protein, 1105 aa, synthetic construct
  REGION 1..1105: note = NEO1 (Q92859) SP+PP+ECD
MAAERGARRLLSTPSFWLYCLLLLGRRAPGAAAARSGSAPQSPGASIRTFTPFYFLVEPVDTLSVRGSSVILNCSAYSEPSPKIEWKKDGTFLNLVSDDRRQLLPDGSLFISNVVHSKHNKPDEGYYQCVATVESLGTIISRTAKLIVAGLPRFTSQPEPSSVYAGNNAILNCEVNADLVPFVRWEQNRQPLLLDDRVIKLPSGMLVISNATEGDGGLYRCVVESGGPPKYSDEVELKVLPDPEVISDLVFLKQPSPLVRVIGQDVVLPCVASGLPTPTIKWMKNEEALDTESSERLVLLAGGSLEISDVTEDDAGTYFCIADNGNETIEAQAELTVQAQPEFLKQPTNIYAHESMDIVFECEVTGKPTPTVKWVKNGDMVIPSDYFKIVKEHNLQVLGLVKSDEGFYQCIAENDVGNAQAGAQLIILEHAPATTGPLPSAPRDVVASLVSTRFIKLTWRTPASDPHGDNLTYSVFYTKEGIARERVENTSHPGEMQVTIQNLMPATVYIFRVMAQNKHGSGESSAPLRVETQPEVQLPGPAPNLRAYAASPTSITVTWETPVSGNGEIQNYKLYYMEKGTDKEQDVDVSSHSYTINGLKKYTEYSFRVVAYNKHGPGVSTPDVAVRTLSDVPSAAPQNLSLEVRNSKSIMIHWQPPAPATQNGQITGYKIRYRKASRKSDVTETLVSGTQLSQLIEGLDRGTEYNFRVAALTINGTGPATDWLSAETFESDLDETRVPEVPSSLHVRPLVTSIVVSWTPPENQNIVVRGYAIGYGIGSPHAQTIKVDYKQRYYTIENLDPSSHYVITLKAFNNVGEGIPLYESAVTRPHTDTSEVDLFVINAPYTPVPDPTPMMPPVGVQASILSHDTIRITWADNSLPKHQKITDSRYYTVRWKTNIPANTKYKNANATTLSYLVTGLKPNTLYEFSVMVTKGRRSSTWSMTAHGTTFELVPTSPPKDVTVVSKEGKPKTIIVNWQPPSEANGKITGYIIYYSTDVNAEIHDWVIEPVVGNRLTHQIQELTLDTPYYFKIQARNSKGMGPMSEAVQFRTPKADSSDKMPNDQASGSGGKGSRLPDLGSDYKPPMSGSNSPHGSPTSPLDSNML

SEQ ID NO: 2766 - protein, 344 aa, synthetic construct
  REGION 1..344: note = NETO1 (Q8TDF5) SP+PP+ECD
MIHGRSVLHIVASLIILHLSGATKKGTEKQTTSETQKSVQCGTWTKHAEGGIFTSPNYPSKYPPDRECIYIIEAAPRQCIELYFDEKYSIEPSWECKFDHIEVRDGPFGFSPIIGRFCGQQNPPVIKSSGRFLWIKFFADGELESMGFSARYNFTPDPDFKDLGALKPLPACEFEMGGSEGIVESIQIMKEGKATASEAVDCKWYIRAPPRSKIYLRFLDYEMQNSNECKRNFVAVYDGSSSVEDLKAKFCSTVANDVMLRTGLGVIRMWADEGSRNSRFQMLFTSFQEPPCEGNTFFCHSNMCINNTLVCNGLQNCVYPWDENHCKEKRKTSLLDQLTNTSGT

SEQ ID NO: 2767 - protein, 347 aa, synthetic construct
  REGION 1..347: note = NETO2 (Q8NC67) SP+PP+ECD
MALERLCSVLKVLLITVLVVEGIAVAQKTQDGQNIGIKHIPATQCGIWVRTSNGGHFASPNYPDSYPPNKECIYILEAAPRQRIELTFDEHYYIEPSFECRFDHLEVRDGPFGFSPLIDRYCGVKSPPLIRSTGRFMWIKFSSDEELEGLGFRAKYSFIPDPDFTYLGGILNPIPDCQFELSGADGIVRSSQVEQEEKTKPGQAVDCIWTIKATPKAKIYLRFLDYQMEHSNECKRNFVAVYDGSSSIENLKAKFCSTVANDVMLKTGIGVIRMWADEGSRLSRFRMLFTSFVEPPCTSSTFFCHSNMCINNSLVCNGVQNCAYPWDENHCKEKKKAGVFEQITKTH

SEQ ID NO: 2768 - protein, 163 aa, synthetic construct
  REGION 1..163: note = NFAM1 (Q8NET5) SP+PP+ECD
MENQPVRWRALPGLPRPPGLPAAPWLLLGVLLLPGTLRLAGGQSVTHTGLPIMASLANTAISFSCRITYPYTPQFKVFTVSYFHEDLQGQRSPKKPTNCHPGLGTENQSHTLDCQVTLVLPGASATGTYYCSVHWPHSTVRGSGTFILVRDAGYREPPQSPQK

SEQ ID NO: 2769 - protein, 1217 aa, synthetic construct
  REGION 1..1217: note = NFASC (O94856) SP+PP+ECD
MARQPPPPWVHAAFLLCLLSLGGAIEIPMDPSIQNELTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLADQATPTNRLAALPKGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDYPRAAPTEVKVRVMNSTAISLQWNRVYSDTVQGQLREYRAYYWRESSLLKNLWVSQKRQQASFPGDRLRGVVSRLFPYSNYKLEMVVVNGRGDGPRSETKEFTTPEGVPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEATPTAAPPTLPPTTVGATGAVSSTDATAIAATTEATTVPIIPTVAPTTIATTTTVATTTTTTAAATTTTESPPTTTSGTKIHESAPDEQSIWNVTVLPNSKWANITWKHNFGPGTDFVVEYIDSNHTKKTVPVKAQAQPIQLTDLYPGMTYTLRVYSRDNEGISSTVITFMTSTAYTNNQADIATQGW

SEQ ID NO: 2770 - protein, 250 aa, synthetic construct
  REGION 1..250: note = NGFR (P08138) SP+PP+ECD
MGAGATGRAMDGPRLLLLLLLGVSLGGAKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEANHVDPCLPCTVCEDTERQLRECTRWADAECEEIPGRWITRSTPPEGSDSTAPSTQEPEAPPEQDLIASTVAGVVTTVMGSSQPVVTRGTTDN

SEQ ID NO: 2771 - protein, 717 aa, synthetic construct
  REGION 1..717: note = NLGN1 (Q8N2Q7) SP+PP+ECD
MALPRCTWPNYVWRAVMACLVHRGLGAPLTLCMLGCLLQAGHVLSQKLDDVDPLVATNFGKIRGIKKELNNEILGPVIQFLGVPYAAPPTGERRFQPPEPPSPWSDIRNATQFAPVCPQNIIDGRLPEVMLPVWFTNNLDVVSSYVQDQSEDCLYLNIYVPTEDVKRISKECARKPGKKICRKGGPLTKKQTDDLGDNDGAEDEDIRDSGGPKPVMVYIHGGSYMEGTGNLYDGSVLASYGNVIVITVNYRLGVLGFLSTGDQAAKGNYGLLDLIQALRWTSENIGFFGGDPLRITVFGSGAGGSCVNLLTLSHYSEGNRWSNSTKGLFQRAIAQSGTALSSWAVSFQPAKYARMLATKVGCNVSDTVELVECLQKKPYKELVDQDIQPARYHIAFGPVIDGDVIPDDPQILMEQGEFLNYDIMLGVNQGEGLKFVENIVDSDDGISASDFDFAVSNFVDNLYGYPEGKDVLRETIKFMYTDWADRHNPETRRKTLLALFTDHQWVAPAVATADLHSNFGSPTYFYAFYHHCQTDQVPAWADAAHGDEVPYVLGIPMIGPTELFPCNFSKNDVMLSAVVMTYWTNFAKTGDPNQPVPQDTKFIHTKPNRFEEVAWTRYSQKDQLYLHIGLKPRVKEHYRANKVNLWLELVPHLHNLNDISQYTSTTTKVPSTDITFRPTRKNSVPVTSAFPTAKQDDPKQQPSPFSVDQRDYSTELS

SEQ ID NO: 2772 - protein, 677 aa, synthetic construct
  REGION 1..677: note = NLGN2 (Q8NFZ4) SP+PP+ECD
MWLLALCLVGLAGAQRGGGGPGGGAPGGPGLGLGSLGEERFPVVNTAYGRVRGVRRELNNEILGPVVQFLGVPYATPPLGARRFQPPEAPASWPGVRNATTLPPACPQNLHGALPAIMLPVWFTDNLEAAATYVQNQSEDCLYLNLYVPTEDGPLTKKRDEATLNPPDTDIRDPGKKPVMLFLHGGSYMEGTGNMFDGSVLAAYGNVIVATLNYRLGVLGFLSTGDQAAKGNYGLLDQIQALRWLSENIAHFGGDPERITIFGSGAGASCVNLLILSHHSEGLFQKAIAQSGTAISSWSVNYQPLKYTRLLAAKVGCDREDSAEAVECLRRKPSRELVDQDVQPARYHIAFGPVVDGDVVPDDPEILMQQGEFLNYDMLIGVNQGEGLKFVEDSAESEDGVSASAFDFTVSNFVDNLYGYPEGKDVLRETIKFMYTDWADRDNGEMRRKTLLALFTDHQWVAPAVATAKLHADYQSPVYFYTFYHHCQAEGRPEWADAAHGDELPYVFGVPMVGATDLFPCNFSKNDVMLSAVVMTYWTNFAKTGDPNQPVPQDTKFIHTKPNRFEEVVWSKFNSKEKQYLHIGLKPRVRDNYRANKVAFWLELVPHLHNLHTELFTTTTRLPPYATRWPPRPPAGAPGTRRPPPPATLPPEPEPEPGPRAYDRFPGDSRDYSTELS

SEQ ID NO: 2773 - protein, 709 aa, synthetic construct
  REGION 1..709: note = NLGN3 (Q9NZ94) SP+PP+ECD
MWLRLGPPSLSLSPKPTVGRSLCLTLWFLSLALRASTQAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDVKRISKECARKPNKKICRKGGSGAKKQGEDLADNDGDEDEDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVMLSAVVMTYWTNFAKTGDPNKPVPQDTKFIHTKANRFEEVAWSKYNPRDQLYLHIGLKPRVRDHYRATKVAFWKHLVPHLYNLHDMFHYTSTTTKVPPPDTTHSSHITRRPNGKTWSTKRPAISPAYSNENAQGSWNGDQDAGPLLVENPRDYSTELS

SEQ ID NO: 2774 - protein, 676 aa, synthetic construct
  REGION 1..676: note = NLGN4X (Q8N0W4) SP+PP+ECD
MSRPQGLLWLPLLFTPVCVMLNSNVLLWLTALAIKFTLIDSQAQYPVVNTNYGKIRGLRTPLPNEILGPVEQYLGVPYASPPTGERRFQPPEPPSSWTGIRNTTQFAAVCPQHLDERSLLHDMLPIWFTANLDTLMTYVQDQNEDCLYLNIYVPTEDDIHDQNSKKPVMVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLRNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELS

SEQ ID NO: 2775 - protein, 676 aa, synthetic construct
  REGION 1..676: note = NLGN4Y (Q8NFZ3) SP+PP+ECD
MLRPQGLLWLPLLFTSVCVMLNSNVLLWITALAIKFTLIDSQAQYPVVNTNYGKIQGLRTPLPSEILGPVEQYLGVPYASPPTGERRFQPPESPSSWTGIRNATQFSAVCPQHLDERFLLHDMLPIWFTTSLDTLMTYVQDQNEDCLYLNIYVPMEDDIHEQNSKKPVMVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLKNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELS

SEQ ID NO: 2776 - protein, 1735 aa, synthetic construct
  REGION 1..1735: note = NOTCH1 (P46531) SP+PP+ECD
MPPLLAPLLCLALLPALAARGPRCSQPGETCLNGGKCEAANGTEACVCGGAFVGPRCQDPNPCLSTPCKNAGTCHVVDRRGVADYACSCALGFSGPLCLTPLDNACLTNPCRNGGTCDLLTLTEYKCRCPPGWSGKSCQQADPCASNPCANGGQCLPFEASYICHCPPSFHGPTCRQDVNECGQKPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCRCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCICMPGYEGVHCEVNTDECASSPCLHNGRCLDKINEFQCECPTGFTGHLCQYDVDECASTPCKNGAKCLDGPNTYTCVCTEGYTGTHCEVDIDECDPDPCHYGSCKDGVATFTCLCRPGYTGHHCETNINECSSQPCRHGGTCQDRDNAYLCFCLKGTTGPNCEINLDDCASSPCDSGTCLDKIDGYECACEPGYTGSMCNINIDECAGNPCHNGGTCEDGINGFTCRCPEGYHDPTCLSEVNECNSNPCVHGACRDSLNGYKCDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRQSEDYESFSCVCPTGWQGQTCEVDINECVLSPCRHGASCQNTHGGYRCHCQAGYSGRNCETDIDDCRPNPCHNGGSCTDGINTAFCDCLPGFRGTFCEEDINECASDPCRNGANCTDCVDSYTCTCPAGFSGIHCENNTPDCTESSCFNGGTCVDGINSFTCLCPPGFTGSYCQHDVNECDSQPCLHGGTCQDGCGSYRCTCPQGYTGPNCQNLVHWCDSSPCKNGGKCWQTHTQYRCECPSGWTGLYCDVPSVSCEVAAQRQGVDVARLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPLIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPDALLGQVKASLLPGGSEGGRRRRELDPMDVRGSIVYLEIDNRQCVQASSQCFQSATDVAAFLGALASLGSLNIPYKIEAVQSETVEPPPPAQLH

SEQ ID NO: 2777 - protein, 1677 aa, synthetic construct
  REGION 1..1677: note = NOTCH2 (Q04721) SP+PP+ECD
MPALRPALLWALLALWLCCAAPAHALQCRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQYCDSLYVPCAPSPCVNGGTCRQTGDFTFECNCLPGFEGSTCERNIDDCPNHRCQNGGVCVDGVNTYNCRCPPQWTGQFCTEDVDECLLQPNACQNGGTCANRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCIHGICMDGINRYSCVCSPGFTGQRCNIDIDECASNPCRKGATCINGVNGFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKESPNFESYTCLCAPGWQGQRCTIDIDECISKPCMNHGLCHNTQGSYMCECPPGFSGMDCEEDIDDCLANPCQNGGSCMDGVNTFSCLCLPGFTGDKCQTDMNECLSEPCKNGGTCSDYVNSYTCKCQAGFDGVHCENNINECTESSCFNGGTCVDGINSFSCLCPVGFTGSFCLHEINECSSHPCLNEGTCVDGLGTYRCSCPLGYTGKNCQTLVNLCSRSPCKNKGTCVQKKAESQCLCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGLLCEENIDDCARGPHCLNGGQCMDRIGGYSCRCLPGFAGERCEGDINECLSNPCSSEGSLDCIQLTNDYLCVCRSAFTGRHCETFVDVCPQMPCLNGGTCAVASNMPDGFICRCPPGFSGARCQSSCGQVKCRKGEQCVHTASGPRCFCPSPRDCESGCASSPCQHGGSCHPQRQPPYYSCQCAPPFSGSRCELYTAPPSTPPATCLSQYCADKARDGVCDEACNSHACQWDGGDCSLTMENPWANCSSPLPCWDYINNQCDELCNTVECLFDNFECQGNSKTCKYDKYCADHFKDNHCDQGCNSEECGWDGLDCAADQPENLAEGTLVIVVLMPPEQLLQDARSFLRALGTLLHTNLRIKRDSQGELMVYPYYGEKSAAMKKQRMTRRSLPGEQEQEVAGSKVFLEIDNRQCVQDSDHCFKNTDAAAALLASHAIQGTLSYPLVSVVSESLTPERTQ

SEQ ID NO: 2778 - protein, 1643 aa, synthetic construct
  REGION 1..1643: note = NOTCH3 (Q9UM47) SP+PP+ECD
MGPGARGRRRRRRPMSPPPPPPPVRALPLLLLLAGPGAAAPPCLDGSPCANGGRCTQLPSREAACLCPPGWVGERCQLEDPCHSGPCAGRGVCQSSVVAGTARFSCRCPRGFRGPDCSLPDPCLSSPCAHGARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGTLCDRNVDDCSPDPCHHGRCVDGIASFSCACAPGYTGTRCESQVDECRSQPCRHGGKCLDLVDKYLCRCPSGTTGVNCEVNIDDCASNPCTFGVCRDGINRYDCVCQPGFTGPLCNVEINECASSPCGEGGSCVDGENGFRCLCPPGSLPPLCLPPSHPCAHEPCSHGICYDAPGGFRCVCEPGWSGPRCSQSLARDACESQPCRAGGTCSSDGMGFHCTCPPGVQGRQCELLSPCTPNPCEHGGRCESAPGQLPVCSCPQGWQGPRCQQDVDECAGPAPCGPHGICTNLAGSFSCTCHGGYTGPSCDQDINDCDPNPCLNGGSCQDGVGSFSCSCLPGFAGPRCARDVDECLSNPCGPGTCTDHVASFTCTCPPGYGGFHCEQDLPDCSPSSCFNGGTCVDGVNSFSCLCRPGYTGAHCQHEADPCLSRPCLHGGVCSAAHPGFRCTCLESFTGPQCQTLVDWCSRQPCQNGGRCVQTGAYCLCPPGWSGRLCDIRSLPCREAAAQIGVRLEQLCQAGGQCVDEDSSHYCVCPEGRTGSHCEQEVDPCLAQPCQHGGTCRGYMGGYMCECLPGYNGDNCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQPFWGPRCERVARSCRELQCPVGVPCQQTPRGPRCACPPGLSGPSCRSFPGSPPGASNASCAAAPCLHGGSCRPAPLAPFFRCACAQGWTGPRCEAPAAAPEVSEEPRCPRAACQAKRGDQRCDRECNSPGCGWDGGDCSLSVGDPWRQCEALQCWRLFNNSRCDPACSSPACLYDNFDCHAGGRERTCNPVYEKYCADHFADGRCDQGCNTEECGWDGLDCASEVPALLARGVLVLTVLLPPEELLRSSADFLQRLSAILRTSLRFRLDAHGQAMVFPYHRPSPGSEPRARRELAPEVIGSVVMLEIDNRLCLQSPENDHCFPDAQSAADYLGALSAVERLDFPYPLRDVRGEPLEPPEPSVPL

SEQ ID NO: 2779 - protein, 1447 aa, synthetic construct
  REGION 1..1447: note = NOTCH4 (Q99466) SP+PP+ECD
MQPPSLLLLLLLLLLLCVSVVRPRGLLCGSFPEPCANGGTCLSLSLGQGTCQCAPGFLGETCQFPDPCQNAQLCQNGGSCQALLPAPLGLPSSPSPLTPSFLCTCLPGFTGERCQAKLEDPCPPSFCSKRGRCHIQASGRPQCSCMPGWTGEQCQLRDFCSANPCVNGGVCLATYPQIQCHCPPGFEGHACERDVNECFQDPGPCPKGTSCHNTLGSFQCLCPVGQEGPRCELRAGPCPPRGCSNGGTCQLMPEKDSTFHLCLCPPGFIGPDCEVNPDNCVSHQCQNGGTCQDGLDTYTCLCPETWTGWDCSEDVDECETQGPPHCRNGGTCQNSAGSFHCVCVSGWGGTSCEENLDDCIAATCAPGSTCIDRVGSFSCLCPPGRTGLLCHLEDMCLSQPCHGDAQCSTNPLTGSTLCLCQPGYSGPTCHQDLDECLMAQQGPSPCEHGGSCLNTPGSFNCLCPPGYTGSRCEADHNECLSQPCHPGSTCLDLLATFHCLCPPGLEGQLCEVETNECASAPCLNHADCHDLLNGFQCICLPGFSGTRCEEDIDECRSSPCANGGQCQDQPGAFHCKCLPGFEGPRCQTEVDECLSDPCPVGASCLDLPGAFFCLCPSGFTGQLCEVPLCAPNLCQPKQICKDQKDKANCLCPDGSPGCAPPEDNCTCHHGHCQRSSCVCDVGWTGPECEAELGGCISAPCAHGGTCYPQPSGYNCTCPTGYTGPTCSEEMTACHSGPCLNGGSCNPSPGGYYCTCPPSHTGPQCQTSTDYCVSAPCFNGGTCVNRPGTFSCLCAMGFQGPRCEGKLRPSCADSPCRNRATCQDSPQGPRCLCPTGYTGGSCQTLMDLCAQKPCPRNSHCLQTGPSFHCLCLQGWTGPLCNLPLSSCQKAALSQGIDVSSLCHNGGLCVDSGPSYFCHCPPGFQGSLCQDHVNPCESRPCQNGATCMAQPSGYLCQCAPGYDGQNCSKELDACQSQPCHNHGTCTPKPGGFHCACPPGFVGLRCEGDVDECLDQPCHPTGTAACHSLANAFYCQCLPGHTGQWCEVEIDPCHSQPCFHGGTCEATAGSPLGFICHCPKGFEGPTCSHRAPSCGFHHCHHGGLCLPSPKPGFPPRCACLSGYGGPDCLTPPAPKGCGPPSPCLYNGSCSETTGLGGPGFRCSCPHSSPGPRCQKPGAKGCEGRSGDGACDAGCSGPGGNWDGGDCSLGVPDPWKGCPSHSRCWLLFRDGQCHPQCDSEECLFDGYDCETPPACTPAYDQYCHDHFHNGHCEKGCNTAECGWDGGDCRPEDGDPEWGPSLALLVVLSPPALDQQLFALARVLSLTLRVGLWVRKDRDGRDMVYPYPGARAEEKLGGTRDPTYQERAAPQTQPLGKETDSLSAGFVVVMGVDLSRCGPDHPASRCPWDPGLLLRFLAAMAAVGALEPLLPGPLLAVHPHAGTAPPANQLPW

SEQ ID NO: 2780 - protein, 1055 aa, synthetic construct
  REGION 1..1055: note = NPHS1 (O60500) SP+PP+ECD
MALGTTLRASLLLLGLLTEGLAQLAIPASVPRGFWALPENLTVVEGASVELRCGVSTPGSAVQWAKDGLLLGPDPRIPGFPRYRLEGDPARGEFHLHIEACDLSDDAEYECQVGRSEMGPELVSPRVILSILVPPKLLLLTPEAGTMVTWVAGQEYVVNCVSGDAKPAPDITILLSGQTISDISANVNEGSQQKLFTVEATARVTPRSSDNRQLLVCEASSPALEAPIKASFTVNVLFPPGPPVIEWPGLDEGHVRAGQSLELPCVARGGNPLATLQWLKNGQPVSTAWGTEHTQAVARSVLVMTVRPEDHGAQLSCEAHNSVSAGTQEHGITLQVTFPPSAIIILGSASQTENKNVTLSCVSKSSRPRVLLRWWLGWRQLLPMEETVMDGLHGGHISMSNLTFLARREDNGLTLTCEAFSEAFTKETFKKSLILNVKYPAQKLWIEGPPEGQKLRAGTRVRLVCLAIGGNPEPSLMWYKDSRTVTESRLPQESRRVHLGSVEKSGSTFSRELVLVTGPSDNQAKFTCKAGQLSASTQLAVQFPPTNVTILANASALRPGDALNLTCVSVSSNPPVNLSWDKEGERLEGVAAPPRRAPFKGSAAARSVLLQVSSRDHGQRVTCRAHSAELRETVSSFYRLNVLYRPEFLGEQVLVVTAVEQGEALLPVSVSANPAPEAFNWTFRGYRLSPAGGPRHRILSSGALHLWNVTRADDGLYQLHCQNSEGTAEARLRLDVHYAPTIRALQDPTEVNVGGSVDIVCTVDANPILPGMFNWERLGEDEEDQSLDDMEKISRGPTGRLRIHHAKLAQAGAYQCIVDNGVAPPARRLLRLVVRFAPQVEHPTPLTKVAAAGDSTSSATLHCRARGVPNIVFTWTKNGVPLDLQDPRYTEHTYHQGGVHSSLLTIANVSAAQDYALFTCTATNALGSDQTNIQLVSISRPDPPSGLKVVSLTPHSVGLEWKPGFDGGLPQRFCIRYEALGTPGFHYVDVVPPQATTFTLTGLQPSTRYRVWLLASNALGDSGLADKGTQLPITTPGLHQPSGEPEDQLPTEPPS

SEQ ID NO: 2781 - protein, 473 aa, synthetic construct
  REGION 1..473: note = NPR1 (P16066) SP+PP+ECD
MPGPRRPAGSRLRLLLLLLLPPLLLLLRGSHAGNLTVAVVLPLANTSYPWSWARVGPAVELALAQVKARPDLLPGWTVRTVLGSSENALGVCSDTAAPLAAVDLKWEHNPAVFLGPGCVYAAAPVGRFTAHWRVPLLTAGAPALGFGVKDEYALTTRAGPSYAKLGDFVAALHRRLGWERQALMLYAYRPGDEEHCFFLVEGLFMRVRDRLNITVDHLEFAEDDLSHYTRLLRTMPRKGRVIYICSSPDAFRTLMLLALEAGLCGEDYVFFHLDIFGQSLQGGQGPAPRRPWERGDGQDVSARQAFQAAKIITYKDPDNPEYLEFLKQLKHLAYEQFNFTMEDGLVNTIPASFHDGLLLYIQAVTETLAHGGTVTDGENITQRMWNRSFQGVTGYLKIDSSGDRETDFSLWDMDPENGAFRVVLNYNGTSQELVAVSGRKLNWPLGYPPPDIPKCGFDNEDPACNQDHLSTLE

SEQ ID NO: 2782 - protein, 458 aa, synthetic construct
  REGION 1..458: note = NPR2 (P20594) SP+PP+ECD
MALPSLLLLVAALAGGVRPPGARNLTLAVVLPEHNLSYAWAWPRVGPAVALAVEALGRALPVDLRFVSSELEGACSEYLAPLSAVDLKLYHDPDLLLGPGCVYPAASVARFASHWRLPLLTAGAVASGFSAKNDHYRTLVRTGPSAPKLGEFVVTLHGHFNWTARAALLYLDARTDDRPHYFTIEGVFEALQGSNLSVQHQVYAREPGGPEQATHFIRANGRIVYICGPLEMLHEILLQAQRENLTNGDYVFFYLDVFGESLRAGPTRATGRPWQDNRTREQAQALREAFQTVLVITYREPPNPEYQEFQNRLLIRAREDFGVELGPSLMNLIAGCFYDGILLYAEVLNETIQEGGTREDGLRIVEKMQGRRYHGVTGLVVMDKNNDRETDFVLWAMGDLDSGDFQPAAHYSGAEKQIWWTGRPIPWVKGAPPSDNPPCAFDLDDPSCDKTPLSTLAI

SEQ ID NO: 2783 - protein, 481 aa, synthetic construct
  REGION 1..481: note = NPR3 (P17342) SP+PP+ECD
MPSLLVLTFSPCVLLGWALLAGGTGGGGVGGGGGGAGIGGGRQEREALPPQKIEVLVLLPQDDSYLFSLTRVRPAIEYALRSVEGNGTGRRLLPPGTRFQVAYEDSDCGNRALFSLVDRVAAARGAKPDLILGPVCEYAAAPVARLASHWDLPMLSAGALAAGFQHKDSEYSHLTRVAPAYAKMGEMMLALFRHHHWSRAALVYSDDKLERNCYFTLEGVHEVFQEEGLHTSIYSFDETKDLDLEDIVRNIQASERVVIMCASSDTIRSIMLVAHRHGMTSGDYAFFNIELFNSSSYGDGSWKRGDKHDFEAKQAYSSLQTVTLLRTVKPEFEKFSMEVKSSVEKQGLNMEDYVNMFVEGFHDAILLYVLALHEVLRAGYSKKDGGKIIQQTWNRTFEGIAGQVSIDANGDRYGDFSVIAMTDVEAGTQEVIGDYFGKEGRFEMRPNVKYPWGPLKLRIDENRIVEHTNSSPCKSSGGLEE

SEQ ID NO: 2784 - protein, 339 aa, synthetic construct
  REGION 1..339: note = NPTN (Q9Y639) SP+PP+ECD
MSGSSLPSALALSLLLVSGSLLPGPGAAQNAGFVKSPMSETKLTGDAFELYCDVVGSPTPEIQWWYAEVNRAESFRQLWDGARKRRVTVNTAYGSNGVSVLRITRLTLEDSGTYECRASNDPKRNDLRQNPSITWIRAQATISVLQKPRIVTSEEVIIRDSPVLPVTLQCNLTSSSHTLTYSYWTKNGVELSATRKNASNMEYRINKPRAEDSGEYHCVYHFVSAPKANATIEVKAAPDITGHKRSENKNEGQDATMYCKSVGYPHPDWIWRKKENGMPMDIVNTSGRFFIINKENYTELNIVNLQITEDPGEYECNATNAIGSASVVTVLRVRSHLAP

SEQ ID NO: 2785 - protein, 1167 aa, synthetic construct
  REGION 1..1167: note = NRCAM (Q92823) SP+PP+ECD
MQLKIMPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAGILPPDVGAGKVQAVNPRISNLTAAAAETYANISWEYEGPEHVNFYVEYGVAGSKEEWRKEIVNGSRSFFGLKGLMPGTAYKVRVGAVGDSGFVSSEDVFETGPAMASRQVDIATQ

SEQ ID NO: 2786 - protein, 856 aa, synthetic construct
  REGION 1..856: note = NRP1 (O14786) SP+PP+ECD
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFVPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGGTTVLATEKPTVIDSTIQSEFPTYGFNCEFGWGSHKTFCHWEHDNHVQLKWSVLTSKTGPIQDHTGDGNFIYSQADENQKGKVARLVSPVVYSQNSAHCMTFWYHMSGSHVGTLRVKLRYQKPEEYDQLVWMAIGHQGDHWKEGRVLLHKSLKLYQVIFEGEIGKGNLGGIAVDDISINNHISQEDCAKPADLDKKNPEIKIDETGSTPGYEGEGEGDKNISRKPGNVLKTLDP

SEQ ID NO: 2787 - protein, 864 aa, synthetic construct
  REGION 1..864: note = NRP2 (O60462) SP+PP+ECD
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAGENFKVDIPEIHEREGYEDEIDDEYEVDWSNSSSATSGSGAPSTDKEKSWLYTLDP

SEQ ID NO: 2788 - protein, 650 aa, synthetic construct
  REGION 1..650: note = NRROS (Q86YC3) SP+PP+ECD
MELLPLWLCLGFHFLTVGWRNRSGTATAASQGVCKLVGGAADCRGQSLASVPSSLPPHARMLTLDANPLKTLWNHSLQPYPLLESLSLHSCHLERISRGAFQEQGHLRSLVLGDNCLSENYEETAAALHALPGLRRLDLSGNALTEDMAALMLQNLSSLRSVSLAGNTIMRLDDSVFEGLERLRELDLQRNYIFEIEGGAFDGLAELRHLNLAFNNLPCIVDFGLTRLRVLNVSYNVLEWFLATGGEAAFELETLDLSHNQLLFFPLLPQYSKLRTLLLRDNNMGFYRDLYNTSSPREMVAQFLLVDGNVTNITTVSLWEEFSSSDLADLRFLDMSQNQFQYLPDGFLRKMPSLSHLNLHQNCLMTLHIREHEPPGALTELDLSHNQLSELHLAPGLASCLGSLRLFNLSSNQLLGVPPGLFANARNITTLDMSHNQISLCPLPAASDRVGPPSCVDFRNMASLRSLSLEGCGLGALPDCPFQGTSLTYLDLSSNWGVLNGSLAPLQDVAPMLQVLSLRNMGLHSSFMALDFSGFGNLRDLDLSGNCLTTFPRFGGSLALETLDLRRNSLTALPQKAVSEQLSRGLRTIYLSQNPYDCCGVDGWGALQHGQTVADWAMVTCNLSSKIIRVTELPGGVPRDCKWERLDLGL

SEQ ID NO: 2789 - protein, 396 aa, synthetic construct
  REGION 1..396: note = NRXN1 (P58400) SP+PP+ECD
MYQRMLRCGAELGSPGGGGGGGGGGGAGGRLALLWIVPLTLSGLLGVAWGASSLGAHHIHHFHGSSKHHSVPIAIYRSPASLRGGHAGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTT

SEQ ID NO: 2790 - protein, 396 aa, synthetic construct; identical to SEQ ID NO: 2789
  REGION 1..396: note = NRXN1 (Q9ULB1) SP+PP+ECD

SEQ ID NO: 2791 - protein, 590 aa, synthetic construct
  REGION 1..590: note = NRXN2 (P58401) SP+PP+ECD
MPPGGSGPGGCPRRPPALAGPLPPPPPPPPPPLLPLLPLLLLLLLGAAEGARVSSSLSTTHHVHHFHSKHGTVPIAINRMPFLTRGGHAGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGNFDNERLAIARQRIPYRLGRVVDEWLLDKGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQNTDDLLVASAECPSDDEDLEECEPSTGGELILPIITEDSLDPPPVATRSPFVPPPPTFYPFLTGVGATQDTLPPPAARRPPSGGPCQAERDDSDCEEPIEASGFASGEVFDSSLPPTDDEDFYTTFPLVTDRTTLLSPRKPAPRPNLRTDGATGAPGVLFAPSAPAPNLPAGKMNHRDPLQPLLENPPLGPGAPTSFEPRRPPPLRPGVTSAPGFPHLPTANPTGPGERGPPGAVEVIRESSSTT

SEQ ID NO: 2792 - protein, 590 aa, synthetic construct; identical to SEQ ID NO: 2791
  REGION 1..590: note = NRXN2 (Q9P2S2) SP+PP+ECD

SEQ ID NO: 2793 - protein, 562 aa, synthetic construct
  REGION 1..562: note = NRXN3 (Q9HDB5) SP+PP+ECD
MHLRIHARRSPPRRPAWTLGIWFLFWGCIVSSVWSSSNVASSSSTSSSPGSHSQHEHHFHGSKHHSVPISIYRSPVSLRGGHAGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTGGELVIPLLVEDPLATPPIATRAPSITLPPTFRPLLTIIETTKDSLSMTSEAGLPCLSDQGSDGCDDDGLVISGYGSGETFDSNLPPTDDEDFYTTFSLVTDKSLSTSIFEGGYKAHAPKWESKDFRPNKVSETSRTTTTSLSPELIRFTASSSSGMVPKLPAGKMNNRDLKPQPDIVLLPLPTAYELDSTKLKSPLITSPMFRNVPTANPTEPGIRRVPGASEVIRESSSTT

SEQ ID NO: 2794 - protein, 562 aa, synthetic construct; identical to SEQ ID NO: 2793
  REGION 1..562: note = NRXN3 (Q9Y4C0) SP+PP+ECD

SEQ ID NO: 2795 - protein, 423 aa, synthetic construct
  REGION 1..423: note = NTRK1 (P04629) SP+PP+ECD
MLRGGRRGQLGWHSWAAGPGSLLAWLILASAGAAPCPDACCPHGSSGLRCTRDGALDSLHHLPGAENLTELYIENQQHLQHLELRDLRGLGELRNLTIVKSGLRFVAPDAFHFTPRLSRLNLSFNALESLSWKTVQGLSLQELVLSGNPLHCSCALRWLQRWEEEGLGGVPEQKLQCHGQGPLAHMPNASCGVPTLKVQVPNASVDVGDDVLLRCQVEGRGLEQAGWILTELEQSATVMKSGGLPSLGLTLANVTSDLNRKNVTCWAENDVGRAEVSVQVNVSFPASVQLHTAVEMHHWCIPFSVDGQPAPSLRWLFNGSVLNETSFIFTEFLEPAANETVRHGCLRLNQPTHVNNGNYTLLAANPFGQASASIMAAFMDNPFEFNPEDPIPVSFSPVDTNSTSGDPVEKKDETPFGVSVAVG

SEQ ID NO: 2796 - protein, 430 aa, synthetic construct
  REGION 1..430: note = NTRK2 (Q16620) SP+PP+ECD
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREH

SEQ ID NO: 2797 - protein, 429 aa, synthetic construct
  REGION 1..429: note = NTRK3 (Q16288) SP+PP+ECD
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDT

SEQ ID NO: 2798 - protein, 1808 aa, synthetic construct
  REGION 1..1808: note = NUP210 (Q8TEM1) SP+PP+ECD
MAARGRGLLLLTLSVLLAAGPSAAAAKLNIPKVLLPFTRATRVNFTLEASEGCYRWLSTRPEVASIEPLGLDEQQCSQKAVVQARLTQPARLTSIIFAEDITTGQVLRCDAIVDLIHDIQIVSTTRELYLEDSPLELKIQALDSEGNTFSTLAGLVFEWTIVKDSEADRFSDSHNALRILTFLESTYIPPSYISEMEKAAKQGDTILVSGMKTGSSKLKARIQEAVYKNVRPAEVRLLILENILLNPAYDVYLMVGTSIHYKVQKIRQGKITELSMPSDQYELQLQNSIPGPEGDPARPVAVLAQDTSMVTALQLGQSSLVLGHRSIRMQGASRLPNSTIYVVEPGYLGFTVHPGDRWVLETGRLYEITIEVFDKFSNKVYVSDNIRIETVLPAEFFEVLSSSQNGSYHRIRALKRGQTAIDAALTSVVDQDGGVHILQVPVWNQQEVEIHIPITLYPSILTFPWQPKTGAYQYTIRAHGGSGNFSWSSSSHLVATVTVKGVMTTGSDIGFSVIQAHDVQNPLHFGEMKVYVIEPHSMEFAPCQVEARVGQALELPLRISGLMPGGASEVVTLSDCSHFDLAVEVENQGVFQPLPGRLPPGSEHCSGIRVKAEAQGSTTLLVSYRHGHVHLSAKITIAAYLPLKAVDPSSVALVTLGSSKEMLFEGGPRPWILEPSKFFQNVTAEDTDSIGLALFAPHSSRNYQQHWILVTCQALGEQVIALSVGNKPSLTNPFPAVEPAVVKFVCAPPSRLTLAPVYTSPQLDMSCPLLQQNKQVVPVSSHRNPRLDLAAYDQEGRRFDNFSSLSIQWESTRPVLASIEPELPMQLVSQDDESGQKKLHGLQAILVHEASGTTAITATATGYQESHLSSARTKQPHDPLVPLSASIELILVEDVRVSPEEVTIYNHPGIQAELRIREGSGYFFLNTSTADVVKVAYQEARGVAMVHPLLPGSSTIMIHDLCLVFPAPAKAVVYVSDIQELYIRVVDKVEIGKTVKAYVRVLDLHKKPFLAKYFPFMDLKLRAASPIITLVALDEALDNYTITFLIRGVAIGQTSLTASVTNKAGQRINSAPQQIEVFPPFRLMPRKVTLLIGATMQVTSEGGPQPQSNILFSISNESVALVSAAGLVQGLAIGNGTVSGLVQAVDAETGKVVIISQDLVQVEVLLLRAVRIRAPIMRMRTGTQMPIYVTGITNHQNPFSFGNAVPGLTFHWSVTKRDVLDLRGRHHEASIRLPSQYNFAMNVLGRVKGRTGLRVVVKAVDPTSGQLYGLARELSDEIQVQVFEKLQLLNPEIEAEQILMSPNSYIKLQTNRDGAASLSYRVLDGPEKVPVVHVDEKGFLASGSMIGTSTIEVIAQEPFGANQTIIVAVKVSPVSYLRVSMSPVLHTQNKEALVAVPLGMTVTFTVHFHDNSGDVFHAHSSVLNFATNRDDFVQIGKGPTNNTCVVRTVSVGLTLLRVWDAEHPGLSDFMPLPVLQAISPELSGAMVVGDVLCLATVLTSLEGLSGTWSSSANSILHIDPKTGVAVARAVGSVTVYYEVAGHLRTYKEVVVSVPQRIMARHLHPIQTSFQEATASKVIVAVGDRSSNLRGECTPTQREVIQALHPETLISCQSQFKPAVFDFPSQDVFTVEPQFDTALGQYFCSITMHRLTDKQRKHLSMKKTALVVSASLSSSHFSTEQVGAEVPFSPGLFADQAEILLSNHYTSSEIRVFGAPEVLENLEVKSGSPAVLAFAKEKSFGWPSFITYTVGVLDPAAGSQGPLSTTLTFSSPVTNQAIAIPVTVAFVVDRRGPGPYGASLFQHFLDSYQ

SEQ ID NO: 2799 - protein, 1812 aa, synthetic construct
  REGION 1..1812: note = NUP210L (Q5VU65) SP+PP+ECD
MTGCPASSRRRGFGLFFFLRLHRLLLLFLVLRGTLANKLNVPQVLLPFGREPGRVPFLLEAQRGCYTWHSTHHDAVTVEPLYENGTLCSQKAVLIAESTQPIRLSSIILAREIVTDHELRCDVKVDVINSIEIVSRARELYVDDSPLELMVRALDAEGNTFSSLAGMMFEWSIAQDNESAREELSSKIRILKYSEAEYAPPIYIAEMEKEEKQGDVILVSGIRTGAAVVKVRIHEPFYKKVAAALIRLLVLENIFLIPSHDIYLLVGTYIKYQVAKMVQGRVTEVKFPLEHYILELQDHRVALNGSHSEKVAILDDKTAMVTASQLGQTNLVFVHKNVHMRSVSGLPNCTIYVVEPGFLGFTVQPGNRWSLEVGQVYVITVDVFDKSSTKVYISDNLRITYDFPKEYFEEQLTTVNGSYHIVKALKDGVVVINASLTSIIYQNKDIQPIKFLIKHQQEVKIYFPIMLTPKFLAFPHHPMGMLYRYKVQVEGGSGNFTWTSSNETVVIVTTKGVVTAGQVRGNSTVLARDVQNPFRYGEIKIHVLKLNKMELLPFHADVEIGQIIEIPIAMYHINKETKEAMAFTDCSHLSLDLNMDKQGVFTLLKEGIQRPGPMHCSSTHIAAKSLGHTLVTVSVNECDKYLESSATFAAYEPLKALNPVEVALVTWQSVKEMVFEGGPRPWILEPSRFFLELNAEKTEKIGIAQVWLPSKRKQNQYIYRIQCLDLGEQVLTFRIGNHPGVLNPSPAVEVLQVRFICAHPASMSVTPVYKVPAGAQPCPLPQHNKWLIPVSRLRDTVLELAVFDQHRRKFDNFSSLMLEWKSSNETLAHFEDYKSVEMVAKDDGSGQTRLHGHQILKVHQIKGTVLIGVNFVGYSEKKSPKEISNLPRSVDVELLLVDDVTVVPENATIYNHPDVKETFSLVEGSGYFLVNSSEQGVVTITYMEAESSVELVPLHPGFFTLEVYDLCLAFLGPATAHLRVSDIQELELDLIDKVEIDKTVLVTVRVLGSSKRPFQNKYFRNMELKLQLASAIVTLTPMEQQDEYSENYILRATTIGQTTLVAIAKDKMGRKYTSTPRHIEVFPPFRLLPEKMTLIPMNMMQVMSEGGPQPQSIVHFSISNQTVAVVNRRGQVTGKIVGTAVVHGTIQTVNEDTGKVIVFSQDEVQIEVVQLRAVRILAAATRLITATKMPVYVMGVTSTQTPFSFSNANPGLTFHWSMSKRDVLDLVPRHSEVFLQLPVEHNFAMVVHTKAAGRTSIKVTVHCMNSSSGQFEGNLLELSDEVQILVFEKLQLFYPECQPEQILMPINSQLKLHTNREGAAFVSSRVLKCFPNSSVIEEDGEGLLKAGSIAGTAVLEVTSIEPFGVNQTTITGVQVAPVTYLRVSSQPKLYTAQGRTLSAFPLGMSLTFTVQFYNSIGEKFHTHNTQLYLALNRDDLLHIGPGNKNYTYMAQAVNRGLTLVGLWDRRHPGMADYIPVAVEHAIEPDTKLTFVGDIICFSTHLVSQHGEPGIWMISANNILQTDIVTGVGVARSPGTAMIFHDIPGVVKTYREVVVNASSRLMLSYDLKTYLTNTLNSTVFKLFITTGRNGVNLKGFCTPNQALAITKVLLPATLMLCHVQFSNTLLDIPASKVFQVHSDFSMEKGVYVCIIKVRPQSEELLQALSVADTSVYGWATLVSERSKNGMQRILIPFIPAFYINQSELVLSHKQDIGEIRVLGVDRVLRKLEVISSSPVLVVAGHSHSPLTPGLAIYSVRVVNFTSFQQMASPVFINISCVLTSQSEAVVVRAMKDKLGADHCEDSAILKRFTGSYQ

SEQ ID NO: 2800 - protein, 740 aa, synthetic construct
  REGION 1..740: note = OSMR (Q99650) SP+PP+ECD
MALFAVFQTTFFLTLLSLRTYQSEVLAERLPLTPVSLKVSTNSTRQSLHLQWTVHNLPYHQELKMVFQIQISRIETSNVIWVGNYSTTVKWNQVLHWSWESELPLECATHFVRIKSLVDDAKFPEPNFWSNWSSWEEVSVQDSTGQDILFVFPKDKLVEEGTNVTICYVSRNIQNNVSCYLEGKQIHGEQLDPHVTAFNLNSVPFIRNKGTNIYCEASQGNVSEGMKGIVLFVSKVLEEPKDFSCETEDFKTLHCTWDPGTDTALGWSKQPSQSYTLFESFSGEKKLCTHKNWCNWQITQDSQETYNFTLIAENYLRKRSVNILFNLTHRVYLMNPFSVNFENVNATNAIMTWKVHSIRNNFTYLCQIELHGEGKMMQYNVSIKVNGEYFLSELEPATEYMARVRCADASHFWKWSEWSGQNFTTLEAAPSEAPDVWRIVSLEPGNHTVTLFWKPLSKLHANGKILFYNVVVENLDKPSSSELHSIPAPANSTKLILDRCSYQICVIANNSVGASPASVIVISADPENKEVEEERIAGTEGGFSLSWKPQPGDVIGYVVDWCDHTQDVLGDFQWKNVGPNTTSTVISTDAFRPGVRYDFRIYGLSTKRIACLLEKKTGYSQELAPSDNPHVLVDTLTSHSFTLSWKDYSTESQPGFIQGYHVYLKSKARQCHPRFEKAVLSDGSECCKYKIDNPEEKALIVDNLKPESFYEFFITPFTSAGEGPSATFTKVTTPDEHSSM

SEQ ID NO: 2801 - protein, 284 aa, synthetic construct
  REGION 1..284: note = OSTM1 (Q86WC4) SP+PP+ECD
MEPGPTAAQRRCSLPPWLPLGLLLWSGLALGALPFGSSPHRVFHDLLSEQQLLEVEDLSLSLLQGGGLGPLSLPPDLPDLDPECRELLLDFANSSAELTGCLVRSARPVRLCQTCYPLFQQVVSKMDNISRAAGNTSESQSCARSLLMADRMQIVVILSEFFNTTWQEANCANCLTNNSEELSNSTVYFLNLFNHTLTCFEHNLQGNAHSLLQTKNYSEVCKNCREAYKTLSSLYSEMQKMNELENKAEPGTHLCIDVEDAMNITRKLWSRTFNCSVPCSDTVP

SEQ ID NO: 2802 - protein, 863 aa, synthetic construct
  REGION 1..863: note = PAM (P19021) SP+PP+ECD
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQGDFYSLLSKLLGEREDVVHVHKYNPTEKAESESDLVAEIANVVQKKDLGRSDAREGAEHERGNAILVRDRIHKFHRLVSTLRPPESRVFSLQQPPPGEGTWEPEHTGDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKEAEAVVETKMENKPTSSELQKMQEKQKLIKEPGSG

SEQ ID NO: 2803 - protein, 258 aa, synthetic construct
  REGION 1..258: note = PARM1 (Q6UWI2) SP+PP+ECD
MVYKTLFALCILTAGWRVQSLPTSAPLSVSLPTNIVPPTTIWTSSPQNTDADTASPSNGTHNNSVLPVTASAPTSLLPKNISIESREEEITSPGSNWEGTNTDPSPSGFSSTSGGVHLTTTLEEHSSGTPEAGVAATLSQSAAEPPTLISPQAPASSPSSLSTSPPEVFSASVTTNHSSTVTSTQPTGAPTAPESPTEESSSDHTPTSHATAEPVPQEKTPPTTVSGKVMCELIDMETTTTFPRVIMQEVEHALSSGS

SEQ ID NO: 2804 - protein, 852 aa, synthetic construct
  REGION 1..852: note = PCDH1 (Q08174) SP+PP+ECD
MDSGAGGRRCPEAALLILGPPRMEHLRHSPGPGGQRLLLPSMLLALLLLLAPSPGHATRVVYKVPEEQPPNTLIGSLAADYGFPDVGHLYKLEVGAPYLRVDGKTGDIFTTETSIDREGLRECQNQLPGDPCILEFEVSITDLVQNGSPRLLEGQIEVQDINDNTPNFASPVITLAIPENTNIGSLFPIPLASDRDAGPNGVASYELQAGPEAQELFGLQVAEDQEEKQPQLIVMGNLDRERWDSYDLTIKVQDGGSPPRASSALLRVTVLDTNDNAPKFERPSYEAELSENSPIGHSVIQVKANDSDQGANAEIEYTFHQAPEVVRRLLRLDRNTGLITVQGPVDREDLSTLRFSVLAKDRGTNPKSARAQVVVTVKDMNDNAPTIEIRGIGLVTHQDGMANISEDVAEETAVALVQVSDRDEGENAAVTCVVAGDVPFQLRQASETGSDSKKKYFLQTTTPLDYEKVKDYTIEIVAVDSGNPPLSSTNSLKVQVVDVNDNAPVFTQSVTEVAFPENNKPGEVIAEITASDADSGSNAELVYSLEPEPAAKGLFTISPETGEIQVKTSLDREQRESYELKVVAADRGSPSLQGTATVLVNVLDCNDNDPKFMLSGYNFSVMENMPALSPVGMVTVIDGDKGENAQVQLSVEQDNGDFVIQNGTGTILSSLSFDREQQSTYTFQLKAVDGGVPPRSAYVGVTINVLDENDNAPYITAPSNTSHKLLTPQTRLGETVSQVAAEDFDSGVNAELIYSIAGGNPYGLFQIGSHSGAITLEKEIERRHHGLHRLVVKVSDRGKPPRYGTALVHLYVNETLANRTLLETLLGHSLDTPLDIDIAGDPEYERSKQRGN

SEQ ID NO: 2805 - protein, 715 aa, synthetic construct
  REGION 1..715: note = PCDH10 (Q9P2E7) SP+PP+ECD
MIVLLLFALLWMVEGVFSQLHYTVQEEQEHGTFVGNIAEDLGLDITKLSARGFQTVPNSRTPYLDLNLETGVLYVNEKIDREQICKQSPSCVLHLEVFLENPLELFQVEIEVLDINDNPPSFPEPDLTVEISESATPGTRFPLESAFDPDVGTNSLRDYEITPNSYFSLDVQTQGDGNRFAELVLEKPLDREQQAVHRYVLTAVDGGGGGGVGEGGGGGGGAGLPPQQQRTGTALLTIRVLDSNDNVPAFDQPVYTVSLPENSPPGTLVIQLNATDPDEGQNGEVVYSFSSHISPRARELFGLSPRTGRLEVSGELDYEESPVYQVYVQAKDLGPNAVPAHCKVLVRVLDANDNAPEISFSTVKEAVSEGAAPGTVVALFSVTDRDSEENGQVQCELLGDVPFRLKSSFKNYYTIVTEAPLDREAGDSYTLTVVARDRGEPALSTSKSIQVQVSDVNDNAPRFSQPVYDVYVTENNVPGAYIYAVSATDRDEGANAQLAYSILECQIQGMSVFTYVSINSENGYLYALRSFDYEQLKDFSFQVEARDAGSPQALAGNATVNILIVDQNDNAPAIVAPLPGRNGTPAREVLPRSAEPGYLLTRVAAVDADDGENARLTYSIVRGNEMNLFRMDWRTGELRTARRVPAKRDPQRPYELVIEVRDHGQPPLSSTATLVVQLVDGAVEPQGGGGSGGGGSGEHQRPSRSGGGETSLDLT

SEQ ID NO: 2806 - protein, 812 aa, synthetic construct
  REGION 1..812: note = PCDH11X (Q9BZA7) SP+PP+ECD
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVK

SEQ ID NO: 2807 - protein, 844 aa, synthetic construct
  REGION 1..844: note = PCDH11Y (Q9BZA8) SP+PP+ECD
MFRVGFLIISSSSSLSPLLLVSVVRVNTTNCHKCLLSGTYIFAVLLVCVVFHSGAQEKNYTIREEIPENVLIGNLLKDLNLSLIPNKSLTTTMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLENAAYLDYESTKEYAIKLLAADAGKPPLNQSAMLFIKVKDENDNAPVFTQSFVTVSIPENNSPGIQLMKVSATDADSGPNAEINYLLGPDAPPEFSLDRRTGMLTVVKKLDREKEDKYLFTILAKDNGVPPLTSNVTVFVSIIDQNDNSPVFTHNEYKFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPYNYSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSIEAPVTPNTEIADVSSPTSDYVK

SEQ ID NO: 2808 - protein, 718 aa, synthetic construct
  REGION 1..718: note = PCDH12 (Q9NPG4) SP+PP+ECD
MMQLLQLLLGLLGPGGYLFLLGDCQEVTTLTVKYQVSEEVPSGTVIGKLSQELGREERRRQAGAAFQVLQLPQALPIQVDSEEGLLSTGRRLDREQLCRQWDPCLVSFDVLATGDLALIHVEIQVLDINDHQPRFPKGEQELEISESASLRTRIPLDRALDPDTGPNTLHTYTLSPSEHFALDVIVGPDETKHAELIVVKELDREIHSFFDLVLTAYDNGNPPKSGTSLVKVNVLDSNDNSPAFAESSLALEIQEDAAPGTLLIKLTATDPDQGPNGEVEFFLSKHMPPEVLDTFSIDAKTGQVILRRPLDYEKNPAYEVDVQARDLGPNPIPAHCKVLIKVLDVNDNIPSIHVTWASQPSLVSEALPKDSFIALVMADDLDSGHNGLVHCWLSQELGHFRLKRTNGNTYMLLTNATLDREQWPKYTLTLLAQDQGLQPLSAKKQLSIQISDINDNAPVFEKSRYEVSTRENNLPSLHLITIKAHDADLGINGKVSYRIQDSPVAHLVAIDSNTGEVTAQRSLNYEEMAGFEFQVIAEDSGQPMLASSVSVWVSLLDANDNAPEVVQPVLSDGKASLSVLVNASTGHLLVPIETPNGLGPAGTDTPPLATHSSRPFLLTTIVARDADSGANGEPLYSIRSGNEAHLFILNPHTGQLFVNVTNASSLIGSEWELEIVVEDQGSPPLQTRALLRVMFVTSVDHLRDSARKPGALSMSMLT

SEQ ID NO: 2809 - protein, 1376 aa, synthetic construct
  REGION 1..1376: note = PCDH15 (Q96QU1) SP+PP+ECD
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGA

SEQ ID NO: 2810 - protein, 707 aa, synthetic construct
  REGION 1..707: note = PCDH17 (O14917) SP+PP+ECD
MYLSICCCFLLWAPALTLKNLNYSVPEEQGAGTVIGNIGRDARLQPGLPPAERGGGGRSKSGSYRVLENSAPHLLDVDADSGLLYTKQRIDRESLCRHNAKCQLSLEVFANDKEICMIKVEIQDINDNAPSFSSDQIEMDISENAAPGTRFPLTSAHDPDAGENGLRTYLLTRDDHGLFGLDVKSRGDGTKFPELVIQKALDREQQNHHTLVLTALDGGEPPRSATVQINVKVIDSNDNSPVFEAPSYLVELPENAPLGTVVIDLNATDADEGPNGEVLYSFSSYVPDRVRELFSIDPKTGLIRVKGNLDYEENGMLEIDVQARDLGPNPIPAHCKVTVKLIDRNDNAPSIGFVSVRQGALSEAAPPGTVIALVRVTDRDSGKNGQLQCRVLGGGGTGGGGGLGGPGGSVPFKLEENYDNFYTVVTDRPLDRETQDEYNVTIVARDGGSPPLNSTKSFAIKILDENDNPPRFTKGLYVLQVHENNIPGEYLGSVLAQDPDLGQNGTVSYSILPSHIGDVSIYTYVSVNPTNGAIYALRSFNFEQTKAFEFKVLAKDSGAPAHLESNATVRVTVLDVNDNAPVIVLPTLQNDTAELQVPRNAGLGYLVSTVRALDSDFGESGRLTYEIVDGNDDHLFEIDPSSGEIRTLHPFWEDVTPVVELVVKVTDHGKPTLSAVAKLIIRSVSGSLPEGVPRVNGEQHHWDMSLP

SEQ ID NO: 2811 - protein, 699 aa, synthetic construct
  REGION 1..699: note = PCDH18 (Q9HCL0) SP+PP+ECD
MHQMNAKMHFRFVFALLIVSFNHDVLGKNLKYRIYEEQRVGSVIARLSEDVADVLLKLPNPSTVRFRAMQRGNSPLLVVNEDNGEISIGATIDREQLCQKNLNCSIEFDVITLPTEHLQLFHIEVEVLDINDNSPQFSRSLIPIEISESAAVGTRIPLDSAFDPDVGENSLHTYSLSANDFFNIEVRTRTDGAKYAELIVVRELDRELKSSYELQLTASDMGVPQRSGSSILKISISDSNDNSPAFEQQSYIIQLLENSPVGTLLLDLNATDPDEGANGKIVYSFSSHVSPKIMETFKIDSERGHLTLFKQVDYEITKSYEIDVQAQDLGPNSIPAHCKIIIKVVDVNDNKPEININLMSPGKEEISYIFEGDPIDTFVALVRVQDKDSGLNGEIVCKLHGHGHFKLQKTYENNYLILTNATLDREKRSEYSLTVIAEDRGTPSLSTVKHFTVQINDINDNPPHFQRSRYEFVISENNSPGAYITTVTATDPDLGENGQVTYTILESFILGSSITTYVTIDPSNGAIYALRIFDHEEVSQITFVVEARDGGSPKQLVSNTTVVLTIIDENDNVPVVIGPALRNNTAEITIPKGAESGFHVTRIRAIDRDSGVNAELSCAIVAGNEENIFIIDPRSCDIHTNVSMDSVPYTEWELSVIIQDKGNPQLHTKVLLKCMIFEYAESVTSTAMTSVSQASLDVS

SEQ ID NO: 2812 - protein, 678 aa, synthetic construct
  REGION 1..678: note = PCDH19 (Q8TAB3) SP+PP+ECD
MESLLLPVLLLLAILWTQAAALINLKYSVEEEQRAGTVIANVAKDAREAGFALDPRQASAFRVVSNSAPHLVDINPSSGLLVTKQKIDRDLLCRQSPKCIISLEVMSSSMEICVIKVEIKDLNDNAPSFPAAQIELEISEAASPGTRIPLDSAYDPDSGSFGVQTYELTPNELFGLEIKTRGDGSRFAELVVEKSLDRETQSHYSFRITALDGGDPPRLGTVGLSIKVTDSNDNNPVFSESTYAVSVPENSPPNTPVIRLNASDPDEGTNGQVVYSFYGYVNDRTRELFQIDPHSGLVTVTGALDYEEGHVYELDVQAKDLGPNSIPAHCKVTVSVLDTNDNPPVINLLSVNSELVEVSESAPPGYVIALVRVSDRDSGLNGRVQCRLLGNVPFRLQEYESFSTILVDGRLDREQHDQYNLTIQARDGGVPMLQSAKSFTVLITDENDNHPHFSKPYYQVIVQENNTPGAYLLSVSARDPDLGLNGSVSYQIVPSQVRDMPVFTYVSINPNSGDIYALRSFNHEQTKAFEFKVLAKDGGLPSLQSNATVRVIILDVNDNTPVITAPPLINGTAEVYIPRNSGIGYLVTVVKAEDYDEGENGRVTYDMTEGDRGFFEIDQVNGEVRTTRTFGESSKSSYELIVVAHDHGKTSLSASALVLIYLSPALDAQESMGSVNLS

SEQ ID NO: 2813 - protein, 890 aa, synthetic construct
  REGION 1..890: note = PCDH20 (Q8N6Y1) SP+PP+ECD
MRGRGNARSSQALGVSWCPATWHPRLDMGRLHRPRSSTSYRNLPHLFLFFLFVGPFSCLGSYSRATELLYSLNEGLPAGVLIGSLAEDLRLLPRSAGRPDPQSQLPERTGAEWNPPLSFSLASRGLSGQYVTLDNRSGELHTSAQEIDREALCVEGGGGTAWSGSVSISSSPSDSCLLLLDVLVLPQEYFRFVKVKIAIRDINDNAPQFPVSQISVWVPENAPVNTRLAIEHPAVDPDVGINGVQTYRLLDYHGMFTLDVEENENGERTPYLIVMGALDRETQDQYVSIIIAEDGGSPPLLGSATLTIGISDINDNCPLFTDSQINVTVYGNATVGTPIAAVQAVDKDLGTNAQITYSYSQKVPQASKDLFHLDENTGVIKLFSKIGGSVLESHKLTILANGPGCIPAVITALVSIIKVIFRPPEIVPRYIANEIDGVVYLKELEPVNTPIAFFTIRDPEGKYKVNCYLDGEGPFRLSPYKPYNNEYLLETTKPMDYELQQFYEVAVVAWNSEGFHVKRVIKVQLLDDNDNAPIFLQPLIELTIEENNSPNAFLTKLYATDADSEERGQVSYFLGPDAPSYFSLDSVTGILTVSTQLDREEKEKYRYTVRAVDCGKPPRESVATVALTVLDKNDNSPRFINKDFSFFVPENFPGYGEIGVISVTDADAGRNGWVALSVVNQSDIFVIDTGKGMLRAKVSLDREQQSSYTLWVEAVDGGEPALSSTAKITILLLDINDNPPLVLFPQSNMSYLLVLPSTLPGSPVTEVYAVDKDTGMNAVIAYSIIGRRGPRPESFRIDPKTGNITLEEALLQTDYGLHRLLVKVSDHGYPEPLHSTVMVNLFVNDTVSNESYIESLLRKEPEINIEEKEPQISIEPTHRKVESVSCMPTL

SEQ ID NO: 2814 - protein, 879 aa, synthetic construct
  REGION 1..879: note = PCDH7 (O60245) SP+PP+ECD
MLRMRTAGWARGWCLGCCLLLPLSLSLAAAKQLLRYRLAEEGPADVRIGNVASDLGIVTGSGEVTFSLESGSEYLKIDNLTGELSTSERRIDREKLPQCQMIFDENECFLDFEVSVIGPSQSWVDLFEGQVIVLDINDNTPTFPSPVLTLTVEENRPVGTLYLLPTATDRDFGRNGIERYELLQEPGGGGSGGESRRAGAADSAPYPGGGGNGASGGGSGGSKRRLDASEGGGGTNPGGRSSVFELQVADTPDGEKQPQLIVKGALDREQRDSYELTLRVRDGGDPPRSSQAILRVLITDVNDNSPRFEKSVYEADLAENSAPGTPILQLRAADLDVGVNGQIEYVFGAATESVRRLLRLDETSGWLSVLHRIDREEVNQLRFTVMARDRGQPPKTDKATVVLNIKDENDNVPSIEIRKIGRIPLKDGVANVAEDVLVDTPIALVQVSDRDQGENGVVTCTVVGDVPFQLKPASDTEGDQNKKKYFLHTSTPLDYEATREFNVVIVAVDSGSPSLSSNNSLIVKVGDTNDNPPMFGQSVVEVYFPENNIPGERVATVLATDADSGKNAEIAYSLDSSVMGIFAIDPDSGDILVNTVLDREQTDRYEFKVNAKDKGIPVLQGSTTVIVQVADKNDNDPKFMQDVFTFYVKENLQPNSPVGMVTVMDADKGRNAEMSLYIEENNNIFSIENDTGTIYSTMSFDREHQTTYTFRVKAVDGGDPPRSATATVSLFVMDENDNAPTVTLPKNISYTLLPPSSNVRTVVATVLATDSDDGINADLNYSIVGGNPFKLFEIDPTSGVVSLVGKLTQKHYGLHRLVVQVNDSGQPSQSTTTLVHVFVNESVSNATAIDSQIARSLHIPLTQDIAGDPSYEISKQRLS

SEQ ID NO: 2815 - protein, 749 aa, synthetic construct
  REGION 1..749: note = PCDH8 (O95206) SP+PP+ECD
MSPVRRWGSPCLFPLQLFSLCWVLSVAQSKTVRYSTFEEDAPGTVIGTLAEDLHMKVSGDTSFRLMKQFNSSLLRVREGDGQLTVGDAGLDRERLCGQAPQCVLAFDVVSFSQEQFRLVHVEVEVRDVNDHAPRFPRAQIPVEVSEGAAVGTRIPLEVPVDEDVGANGLQTVRLAEPHSPFRVELQTRADGAQCADLVLLQELDRESQAAYSLELVAQDGGRPPRSATAALSVRVLDANDHSPAFPQGAVAEVELAEDAPVGSLLLDLDAADPDEGPNGDVVFAFGARTPPEARRLFRLDPRSGRLTLAGPVDYERQDTYELDVRAQDRGPGPRAATCKVIVRIRDVNDNAPDIAITPLAAPGAPATSPFAAAAAAAALGGADASSPAGAGTPEAGATSLVPEGAARESLVALVSTSDRDSGANGQVRCALYGHEHFRLQPAYAGSYLVVTAASLDRERIAEYNLTLVAEDRGAPPLRTVRPYTVRVGDENDNAPLFTRPVYEVSVRENNPPGAYLATVAARDRDLGRNGQVTYRLLEAEVGRAGGAVSTYVSVDPATGAIYALRSFDYETLRQLDVRIQASDGGSPQLSSSALVQVRVLDQNDHAPVLVHPAPANGSLEVAVPGRTAKDTVVARVQARDADEGANGELAFELQQQEPREAFAIGRRTGEILLTGDLSQEPPGRVFRALLVISDGGRPPLTTTATVSFVVTAGGGRGPAAPASAGSPERSRPPGSRLGVSGSVLQWDTP

SEQ ID NO: 2816 - protein, 814 aa, synthetic construct
  REGION 1..814: note = PCDH9 (Q9HC56) SP+PP+ECD
MDLRDFYLLAALIACLRLDSAIAQELIYTIREELPENVPIGNIPKDLNISHINAATGTSASLVYRLVSKAGDAPLVKVSSSTGEIFTTSNRIDREKLCAGASYAEENECFFELEVVILPNDFFRLIKIKIIVKDTNDNAPMFPSPVINISIPENTLINSRFPIPSATDPDTGFNGVQHYELLNGQSVFGLDIVETPEGEKWPQLIVQQNLDREQKDTYVMKIKVEDGGTPQKSSTAILQVTVSDVNDNRPVFKEGQVEVHIPENAPVGTSVIQLHATDADIGSNAEIRYIFGAQVAPATKRLFALNNTTGLITVQRSLDREETAIHKVTVLASDGSSTPARATVTINVTDVNDNPPNIDLRYIISPINGTVYLSEKDPVNTKIALITVSDKDTDVNGKVICFIEREVPFHLKAVYDNQYLLETSSLLDYEGTKEFSFKIVASDSGKPSLNQTALVRVKLEDENDNPPIFNQPVIELSVSENNRRGLYLTTISATDEDSGKNADIVYQLGPNASFFDLDRKTGVLTASRVFDREEQERFIFTVTARDNGTPPLQSQAAVIVTVLDENDNSPKFTHNHFQFFVSENLPKYSTVGVITVTDADAGENKAVTLSILNDNDNFVLDPYSGVIKSNVSFDREQQSSYTFDVKATDGGQPPRSSTAKVTINVMDVNDNSPVVISPPSNTSFKLVPLSAIPGSVVAEVFAVDVDTGMNAELKYTIVSGNNKGLFRIDPVTGNITLEEKPAPTDVGLHRLVVNISDLGYPKSLHTLVLVFLYVNDTAGNASYIYDLIRRTMETPLDRNIGDSSQPYQNEDYLT

SEQ ID NO: 2817 - protein, 697 aa, synthetic construct
  REGION 1..697: note = PCDHA1 (Q9Y5I3) SP+PP+ECD
MVFSRRGGLGARDLLLWLLLLAAWEVGSGQLHYSIPEEAKHGTFVGRVAQDLGLELAELVPRLFRVASKTHRDLLEVNLQNGILFVNSRIDREELCQWSAECSIHLELIADRPLQVFHVEVKVKDINDNPPVFRGREQIIFIPESRLLNSRFPIEGAADADIGANALLTYTLSPSDYFSLDVEASDELSKSLWLELRKYLDREETPELHLLLTATDGGKPELQGTVELLITVLDVNDNAPLFDQAVYRVHLLETTANGTLVTTLNASDADEGVNGEVVFSFDSGISRDIQEKFKVDSSSGEIRLIDKLDYEETKSYEIQVKAVDKGSPPMSNHCKVLVKVLDVNDNAPELAVTSLYLPIREDAPLSTVIALITVSDRDSGANGQVTCSLMPHVPFKLVSTFKNYYSLVLDSALDRESLSVYELVVTARDGGSPSLWATARVSVEVADVNDNAPAFAQPEYTVFVKENNPPGCHIFTVSARDADAQENALVSYSLVERRVGERALSNYVSVHAESGKVYALQPLDHEELELLQFQVSARDAGVPPLGSNVTLQVFVLDENDNAPALLAPRVGGTIGAVSELVPRLVGAGHVVAKVRAVDADSGYNAWLSYELQPAAGGARIPFRVGLYTGEISTTRVLDEADLSRYRLLVLVKDHGEPALTATATVLVSLVESGQAPKASSRASVGVAGPEAALVDVN

SEQ ID NO: 2818 - protein, 695 aa, synthetic construct
  REGION 1..695: note = PCDHA10 (Q9Y5I2) SP+PP+ECD
MVSRCSCLGVQCLLLSLLLLAAWEVGSGQLHYSVYEEARHGTFVGRIAQDLGLELAELVQRLFRVASKRHGDLLEVNLQNGILFVNSRIDREELCGRSVECSIHLEVIVDRPLQVFHVDVEVKDINDNPPRFSVTEQKLSIPESRLLDSRFPLEGASDADVGENALLTYKLSPNEYFVLDIINKKDKDKFPVLVLRKLLDREENPQLKLLLTATDGGKPEFTGSVSLLILVLDANDNAPIFDRPVYEVKMYENQVNQTLVIRLNASDSDEGINKEMMYSFSSLVPPTIRRKFWINERTGEIKVNDAIDFEDSNTYEIHVDVTDKGNPPMVGHCTVLVELLDENDNSPEVIVTSLSLPVKEDAQVGTVIALISVSDHDSGANGQVTCSLTPHVPFKLVSTYKNYYSLVLDSALDRERVSAYELVVTARDGGSPPLWATASVSVEVADVNDNAPAFAQSEYTVFVKENNPPGCHIFTVSAWDADAQENALVSYSLVERRLGERSLSSYVSVHAESGKVYALQPLDHEELELLQFQVSARDGGVPPLGSNLTLQVFVLDENDNAPALLASPAGSAGGAVSELVLRSVVAGHVVAKVRAVDADSGYNAWLSYELQSAAVGARIPFRVGLYTGEISTTRALDETDSPRQRLLVLVKDHGEPSLTATATVLVSLVEGSQAPKASSRASVGVAPEVALVDVN

SEQ ID NO: 2819 - protein, 696 aa, synthetic construct
  REGION 1..696: note = PCDHA11 (Q9Y5I1) SP+PP+ECD
MFGFQRRGLGTPRLQLWLLLLEFWEVGSGQLHYSVSEEAKHGTFVGRIAQDLGLELAELVQRLFRVASKTHGDLLEVNLQNGILFVNSRIDREELCGQSAECSIHLEVIVDRPLQVFHVNVEVKDINDNPPVFSLREQKLLIAESKQSDSRFPLEGASDADIEENALLTYRLSKNEYFSLDSPTNGKQIKRLSLILKKSLDREKTPELNLLLTATDGGKPELTGTVRLLVQVLDVNDNDPEFDKSEYKVSLMENAAKETLVLKLNATDRDEGVNGEVTYSLMSIKPNGRHLFTLDQNNGEVRVNGTLDYEENKFYKIEVQATDKGTPPMAGHCTVWVEILDTNDNSPEVAVTSLSLPVREDAQPSTVIALISVSDRDSGVNGQVTCSLTPHVPFKLVSTFKNYYSLVLDSALDRENVWAYELVVTARDGGSPSLWATARVSVEVADVNDNAPAFAQPEYTVFVKENNPPGCHIFTVSARDADAQENALVSYSLVERRLGDRALSSYVSVHAESGKVYALQPLDHEELELLQFQVSARDAGVPPLSSNVTLQVFVLDENDNAPALLATQAGSAGGAVNKLVPRSVGAGHVVAKVRAVDADSGYNAWLSYELQPAAGGSRIPFRVGLYTGEISTTRALDEADSPRHRLLVLVKDHGEPALTATATVLVSLVESGQAPKASSRTLAGAASPEAALVDVN

SEQ ID NO: 2820 - protein, 697 aa, synthetic construct
  REGION 1..697: note = PCDHA12 (Q9UN75) SP+PP+ECD
MVIIGPRGPGSQRLLLSLLLLAAWEVGSGQLHYSVYEEAKHGTFVGRIAQDLGLELAELVPRLFRVASKRHGDLLEVNLQNGILFVNSRIDREKLCGRSAECSIHLEVIVDRPLQVFHVDVEVKDINDNPPVFREREQKVPVSESAPLDSHFPLEGASDADIGVNSLLTYALSLNENFELKIKTKKDKSILPELVLRKLLDREQTPKLNLLLMVIDGGKPELTGSVQIQITVLDVNDNGPAFDKPSYKVVLSENVQNDTRVIQLNASDPDEGLNGEISYGIKMILPVSEKCMFSINPDTGEIRIYGELDFEENNAYEIQVNAIDKGIPSMAGHSMVLVEVLDVNDNVPEVMVTSLSLPVQEDAQVGTVIALISVSDRDSGANGQVICSLTPHVPFKLVSTYKNYYSLVLDSALDRESVSAYELVVTARDGGSPSLWATARVSVEVADVNDNAPAFAQPEYTVFVKENNPPGCHIFTVSAWDADAQKNALVSYSLVERRVGEHALSSYVSVHAESGKVYALQPLDHEELELLQFQVSARDAGVPPLGSNVTLQVFVLDENDNAPALLATPAGSAGGAVSELVPRSVGAGHVVAKVRAVDADSGYNAWLSYELQPAAVGAHIPFHVGLYTGEISTTRILDEADAPRHRLLVLVKDHGEPALTSTATVLVSLVENGQAPKTSSRASVGAVDPEAALVDIN

SEQ ID NO: 2821 - protein, 697 aa, synthetic construct
  REGION 1..697: note = PCDHA13 (Q9Y5I0) SP+PP+ECD
MLSSWQGGPRPRQLLLWLLILAAWETGSGQLHYSVPEEAKHGTFVGRIAQDLGLELAELVPRLFRVASKRHGDLLEVNLQNGILFVNSRIDREELCGRSAECSIHLEVIVDRPLQVFHVEVKVRDINDNPPIFPESKKRIIIAESRPPETRFPLDGASDADIGVNSALTYRLDPNDYFTLDAQNSLEQMSSLSLVLRKTLDREEIQEHSLLLTASDGGKPELTGTVQLLITILDVNDNAPEFYQSVYKVTVLENAFNGTLVIKLNATDPDDGTNGDIVYSFRRPVWPAVVYAFTINPNNGEIRTKGKLDFEEKKLYEISVEAVDKGNIPMAGHCTLLVEVLDVNDNAPEVTITSLSLPIREDTQPSAIIALISVSDRDSGSNGQVTCTLTPHVPFKLVSTYKNYYSLVLDSALDRESVSAYELVVTARDGGSPSLWATASVSVGVADVNDNAPAFAQPEYTVFVKENNPPGCHIFTVSAQDADAQENALVSYSLVERRVGERALSSYVSVHAESGKVYALQPLDHEELELLQFQVSARDSGVPPLGSNVTLQVFVLDENDNAPALLTPGAGSAGGTVSELMPRSVGAGHVVAKVRAVDADSGYNAWLSYELQLAAVGARIPFRVGLYTGEISTTRPLDEVDAPHHRLLVLVKDHGEPALTATATVLLSLVESGQAPQASSRASAGAVGPEAALVDVN

SEQ ID NO: 2822 - protein, 697 aa, synthetic construct
  REGION 1..697: note = PCDHA2 (Q9Y5H9) SP+PP+ECD
MASSIRRGRGAWTRLLSLLLLAAWEVGSGQLRYSVPEEAKHGTFVGRIAQDLGLELEELVPRLFRVASKRHGDLLEVNLQNGILFVNSRIDREELCGRSAECSIHVEVIVDRPLQVFHVEVEVKDINDNPPIFPMTVKTIRFPESRLLDSRFPLEGASDADIGVNALLSYKLSSSEFFFLDIQANDELSESLSLVLGKSLDREETAEVNLLLVATDGGKPELTGTVQILIKVLDVNDNEPTFAQSVYKVKLLENTANGTLVVKLNASDADEGPNSEIVYSLGSDVSSTIQTKFTIDPISGEIRTKGKLDYEEAKSYEIQVTATDKGTPSMSGHCKISLKLVDINDNTPEVSITSLSLPISENASLGTVIALITVSDRDSGTNGHVTCSLTPHVPFKLVSTFKNYYSLVLDSALDRESVSAYELVVTARDGGSPSLWATTSVSIEVADVNDNAPAFAQPEYTVFVKENNPPGCHIFTVSAWDADAQENALVSYSLVERRVGERALSSYVSVHAESGKVYALQPLDHEEVELLQFQVSARDAGVPPLGSNVTLQVFVLDENDNAPALLAPRAGTAAGAVSELVPWSVGAGHVVAKVRAVDADSGYNAWLSYELQLGTGSARIPFRVGLYTGEISTTRALDEADSPRHRLLVLVKDHGEPALTATATVLVSLVESGQAPKASSRAWVGAAGSEATLVDVN

SEQ ID NO: 2823 - protein, 697 aa, synthetic construct
  REGION 1..697: note = PCDHA3 (Q9Y5H8) SP+PP+ECD
MLFSWREDPGAQCLLLSLLLLAASEVGSGQLHYSVSEEAKHGTFVGRIAQDLGLELAELVPRLFRVASKRHGDLLEVNLQNGILFVNSRIDREELCGRSAECSIHLEVIVDRPLQVFHVEVEVKDINDNAPVFPMAVKNLFISESRQPGSRFSLEGASDADIGTNSLLTYSLDSTEYFTLDVKRNDEEIKSLGLVLKKNLNREDTPKHYLLITAIDGGKPELTGTTQLKITVLDVNDNAPAFERTIYKVRLLENAPNGTLVVTVNATDLDEGVNKDIAYSFNTDMSADILSKFHLDPVNGQISVKGNIDFEESKSYEIQVEATDKGNPPMSDHCTVLLEIVDINDNVPELVIQSLSLPVLEDSPLSTVIALISVSDRDSGVNGQVTCSLTPHVPFKLVSTFKNYYSLVLDSPLDRESVSAYELVVTARDGGSPSLWATASVSVEVADVNDNAPAFSQSEYTVFVKENNPPGCHIFTVSARDADAQENALVSYSLVERRVGERALSSYVSVHAESGKVYALQPLDHEELELLQFQVSARDAGVPPLGSNVTLQVFVLDENDNAPALLMPRVGGIGGAVSELVPRSVGAGHVVAKVRAVDADSGYNAWLSYELQPGTGGARIPFRVGLYTGEISTTRALDEVDAPRHRLLVLVKDHGEPSLTATATVLVSLVESGQAPKASSQASAGATGPEAALVDVN

SEQ ID NO: 2824 - protein, 697 aa, synthetic construct
  REGION 1..697: note = PCDHA4 (Q9UN74) SP+PP+ECD
MEFSWGSGQESRRLLLLLLLLAAWEAGNGQLHYSVSEEAKHGTFVGRIAQDLGLELAELVPRLFRVASKGRGGLLEVNLQNGILFVNSRIDREELCRRSAECSIHLEVIVDRPLQVFHVDVEVRDINDNPPVFPATQKNLSIAESRPLDSRFPLEGASDADIGENALLTYRLSPNEYFSLEKPPDDELVKGLGLILRKSLDREEAPEIFLVLTATDGGKPELTGTVQLLITVLDANDNAPAFDRTIYKVRLLENVPNGTLVIKLNASDLDEGLNGDIVYSFSNDISPNVKSKFHIDPITGQIIVKGYIDFEESKSYEIIVEGIDKGQLPLSGHCRVIVEVEDNNDNVPDLEFKSLSLPIREDAPLGTVIALISVSDKDMGVNGLVTCSLTSHVPFKLVSTFKNYYSLVLDSALDRESVSAYELVVTARDGGSPSLWATASVSVEVADVNDNAPAFAQPEYTVFVKENNPPGCHIFTVSAWDADAQENALVSYSLVERRVGERALSSYVSVHAESGKVYALQPLDHEELELLQFQVTARDAGVPPLGSNVTLQVFVLDENDNAPALLAPRAGGTGGAVSELVPWSVGVGHVVAKVRAVDADSGYNAWLSYELQPGTGGARIPFRVGLYTGEISTTRALDETDAPRHRLLVLVKDHGEPALTATATVLVSLVESGQAPKASSRALVGAVGPDAALVDVN

SEQ ID NO: 2825 - protein, 696 aa, synthetic construct
  REGION 1..696: note = PCDHA5 (Q9Y5H7) SP+PP+ECD
MVYSRRGSLGSRLLLLWLLLAYWKAGSGQLHYSIPEEAKHGTFVGRIAQDLGLELAELVPRLFRVASKGRGDLLEVNLQNGILFVNSRIDREELCRRRAECSIHLEVIVDRPLQVFHVEVAVKDINDNPPRFSRQEQRLFILESRMPDSRFPLEGASDLDIGANAQLRYRLNPNEYFDLDVKTNEEETNFLELVLRKSLDREETQEHRLLVIATDGGKPELTGTVQLLINVLDANDNAPEFDKSIYNVRLLENAPSGTLVIKLNASDADEGINKEIVYFFSNLVLDDVKSKFIINSNTGEIKVNGELDYEDYNSYEINIDAMDKSTFPLSGHCKVVVKLLDVNDNTPEMAITTLFLPVKEDAPLSTVIALISVSDRDSGANGQVTCSLMPHVPFKLVSTFKNYYSLVLDSALDRESVSVYELVVTARDGGSPSLWATASVSVEVADVNDNAPAFAQPQYTVFVKENNPPGCHIFTVSARDADAQENALVSYSLVERRVGERPLSSYVSVHAESGKVYALQPLDHEEVELLQFQVSARDAGVPPLGSNVTLQVFVLDENDNAPALLVPRVGGTGGAVSELVPRSVGAGHVVAKVRAVDPDSGYNAWLSYELQPAPGSARIPFRVGLYTGEISTTRSLDETEAPRHRLLVLVKDHGEPPLTATATVLVSLVESGQAPKASSRASAGAVGPEAALVDVN

SEQ ID NO: 2826 - protein, 697 aa, synthetic construct
  REGION 1..697: note = PCDHA6 (Q9UN73) SP+PP+ECD
MVFTPEDRLGKQCLLLPLLLLAAWKVGSGQLHYSVPEEAKHGTFVGRIAQDLGLELAELVPRLFRMASKDREDLLEVNLQNGILFVNSRIDREELCGRSAECSIHLEVIVDRPLQVFHVDVEVRDINDNPPLFPVEEQRVLIYESRLPDSVFPLEGASDADVGSNSILTYKLSSSEYFGLDVKINSDDNKQIGLLLKKSLDREEAPAHNLFLTATDGGKPELTGTVQLLVTVLDVNDNAPTFEQSEYEVRIFENADNGTTVIRLNASDRDEGANGAISYSFNSLVAAMVIDHFSIDRNTGEIVIRGNLDFEQENLYKILIDATDKGHPPMAGHCTVLVRILDKNDNVPEIALTSLSLPVREDAQFGTVIALISVNDLDSGANGQVNCSLTPHVPFKLVSTFKNYYSLVLDSALDRESVSAYELVVTARDGGSPSLWATASLSVEVADMNDNAPAFAQPEYTVFVKENNPPGCHIFTVSARDADAQENALVSYSLVERRVGERALSSYISVHAESGKVYALQPLDHEELELLQFQVSARDAGVPPLGSNVTLQVFVLDENDNAPALLAPRVGGTGGAVSELVPRSLGAGQVVAKVRAVDADSGYNAWLSYELQPPASSARFPFRVGLYTGEISTTRVLDEADSPRHRLLVLVKDHGEPALTATATVLVSLVESGQAPKASSRASVGAAGPEAALVDVN

SEQ ID NO: 2827 - protein, 697 aa, synthetic construct
  REGION 1..697: note = PCDHA7 (Q9UN72) SP+PP+ECD
MVCPNGYDPGGRHLLLFIIILAAWEAGRGQLHYSVPEEAKHGNFVGRIAQDLGLELAELVPRLFRAVCKFRGDLLEVNLQNGILFVNSRIDREELCGRSAECSIHLEVIVERPLQVFHVDVEVKDINDNPPVFPATQRNLFIAESRPLDSRFPLEGASDADIGENALLTYRLSPNEYFFLDVPTSNQQVKPLGLVLRKLLDREETPELHLLLTATDGGKPELTGTVQLLITVLDNNDNAPVFDRTLYTVKLPENVSIGTLVIHPNASDLDEGLNGDIIYSFSSDVSPDIKSKFHMDPLSGAITVIGHMDFEESRAHKIPVEAVDKGFPPLAGHCTVLVEVVDVNDNAPQLTLTSLSLPIPEDAQPGTVITLISVFDRDFGVNGQVTCSLTPRVPFKLVSTFKNYYSLVLDSALDRESVSAYELVVTARDGGSPSLWATASVSVEVADVNDNAPAFAQPEYTVFVKENNPPGCHIFTVSAGDADAQKNALVSYSLVELRVGERALSSYVSVHAESGKVYALQPLDHEELELLQFQVSARDAGVPPLGSNVTLQVFVLDENDNAPALLAPRVGGTGGAVRELVPRSVGAGHVVAKVRAVDADSGYNAWLSYELQPVAAGASIPFRVGLYTGEISTTRALDETDAPRHRLLVLVKDHGEPSLTATATVLVSLVESGQAPKASSRASLGIAGPETELVDVN

SEQ ID NO: 2828 - protein, 697 aa, synthetic construct
  REGION 1..697: note = PCDHA8 (Q9Y5H6) SP+PP+ECD
MDYHWRGELGSWRLLLLLLLLAAWKVGSGQLHYSVPEEAKHGTFVGRIAQDLGLELAELVPRLFRVASKRHRDLLEVSLQNGILFVNSRIDREELCGRSAECSIHLEVIVDRPLQVFHVDVEVKDVNDNPPVFRVKDQKLFVSESRMPDSRFPLEGASDADVGANSVLTYRLSSHDYFMLDVNSKNDENKLVELVLRKSLDREDAPAHHLFLTATDGGKPELTGTVQLLVTVLDVNDNAPTFEQSEYEVRIFENADNGTTVIKLNASDPDEGANGAISYSFNSLVETMVIDHFSIDRNTGEIVIRGNLDFEQENLYKILIDATDKGHPPMAGHCTVLVRILDKNDNVPEIALTSLSLPVREDAQFGTVIALISVNDLDSGANGQVTCSLMPHVPFKLVSTFKNYYSLVLDSALDRERVSAYELVVTARDGGSPSLWATASLSVEVADVNDNAPAFAQPEYTVFVKENNPPGCHIFTVSARDADAQENALVSYSLVERRVGERSLSSYISVHTESGKVYALQPLDHEELELLQFQVSARDAGVPPLGSNVTLQVFVLDENDNAPALLEPRVGGTGGAASKLVPRSVGAGHVVAKVRAVDADSGYNAWLSYELQPAASSPRIPFRVGLYTGEISTTRVLDEADSPRHRLLVLVKDHGEPALTATATVLVSLVESGQAPKASSRQSAGVLGPEAALVDVN

SEQ ID NO: 2829 - protein, 697 aa, synthetic construct
  REGION 1..697: note = PCDHA9 (Q9Y5H5) SP+PP+ECD
MLYSSRGDPEGQPLLLSLLILAMWVVGSGQLHYSVPEEAEHGTFVGRIAQDLGLELAELVPRLFQLDSKGRGDLLEVNLQNGILFVNSRIDREELCGRSAECSIHLEVIVDRPLQVFHVDVEVKDINDNPPVFPATQKNLFIAESRPLDSRFPLEGASDADIGENALLTYRLSPNEYFFLDVPTSNQQVKPLGLVLRKLLDREETPELHLLLTATDGGKPELTGTVQLLITVLDNNDNAPVFDRTLYTVKLPENVSIGTLVIHPNASDLDEGLNGDIIYSFSSDVSPDIKSKFHMDPLSGAITVIGHMDFEESRAHKIPVEAVDKGFPPLAGHCTLLVEVVDVNDNAPQLTIKTLSVPVKEDAQLGTVIALISVIDLDADANGQVTCSLTPHVPFKLVSTYKNYYSLVLDRALDRESVSAYELVVTARDGGSPSLWATARVSVEVADVNDNAPAFAQSEYTVFVKENNPPGCHIFTVSARDADAQENALVSYSLVERRLGERSLSSYVSVHAESGKVYALQPLDHEELELLQFQVSARDAGVPPLGSNVTLQVFVLDENDNAPALLTPRMRGTDGAVSEMVLRSVGAGVVVGKVRAVDADSGYNAWLSYELQPETASASIPFRVGLYTGEISTTRALDETDAPRQRLLVLVKDHGEPALTATATVLVSLVESGQAPKSSSRASVGATGPEVTLVDVN

SEQ ID NO: 2830 - protein, 683 aa, synthetic construct
  REGION 1..683: note = PCDHAC1 (Q9H158) SP+PP+ECD
MVGCGVAVLCLWVSCGAAAGQLEYSVPEETERGVAVGNLSADLRLPAAAMSSRNFRFLSSHRELYFGVDLPSGNLVVREPADREQLCRAKAACVLTYDLVLEDPLELHKIRIHVLDTNDNSPLFPAGDVQLHIPEFLTPGARFTLPNAQDDDEGSNGILSYSLSPSQHFRLDMGSRVDGSEYPELVLEKALDREQRATHLLVLTARDGGLPARSGDAQVTIIVVDTNDNAPVFERSVYRTKVPETAPNGTVLFRVQALDPDEGSNGEVQYSLSNSTQAELRHRFHVHPKSGEVQVAASLGPPETLLEAYIEARDEGVFGLASTAKLLVEVTDVNDHAPELDFLTLSNPVPEDAAPGTVIALFSVKDEDLDSNGRVICGMSSAGPFQLTASFDNYYSLLIDGPLDREQISEYQVLITASDSGSPPLSTRRTITVSVADVNDNTPNFPQPQQELFVAENNGPGASLGRVFAQDPDLGKNGLVSYELLDVISEGPSASSLLAVESSSGAITAKTSFDFEQLRGFHFQVEGRDGGIPPRSATVTINLFVVDRNDNYPVILFPLPRNGSVPVEIVPRSARTGHLVTKVVAEDADSGSNAWLSYHISRASDSSLFRISANIGELRTARLVLPTDAVKQRVVVVVRDHGDPPLSSSVTLGVLLSNSVPQLLPDFEDVWEPGGQLSAQNLY

SEQ ID NO: 2831 - protein, 708 aa, synthetic construct
  REGION 1..708: note = PCDHAC2 (Q9Y5I4) SP+PP+ECD
MEQAGTRPAATEHPRLRRPMPWLLLLPLLLLLLLLLPGPAASQLRYSVPEEQAPGALVGNVARALGLELRRLGPGCLRINHLGAPSPRYLELDLTSGALFVNERIDREALCEQRPRCLLSLEVLAHNPVAVSAVEVEILDINDNSPRFPRPNYQLQVSESVAPGARFHIESAQDPDVGANSVQTYELSPSEHFELDLKPLQENSKVLELVLRKGLDREQAALHHLVLTAVDGGIPARSGTAQISVRVLDTNDNSPAFDQSTYRVQLREDSPPGTLVVKLNASDPDEGSNGELRYSLSSYTSDRERQLFSIDASTGEVRVIGGLDYEEASSYQIYVQATDRGPVPMAGHCKVLVDIVDVNDNAPEVVLTDLYSPVPENATPNTIVAVLSVNDQDSGPNRKVSLGLEATLPFRLNGFGNSYTLVVSGPLDRERVAVYNITVTATDGGIPQLTSLRTLKVEISDINDNPPSFLEDSYSIYIQENNLPGVLLCTVQATDPDEKENAEVTYSLLEREIQGLPVTSYVSINSASGSLYAVNSFDYEKFREFFVTVEAQDKGSPPLSSTVTANVYVVDMNDHAPHILYPTSTNSSAAFEMVPRTAPAGYLVTKVIAMDSDSGQNAWLFYHLAQTSDLDLFKVELHTGEIRTTRKMGDESGSTFNLTVVVRDNGEPSLSASVAITVAVVDRVSKILPDTQRHVKSPRTYSEITLYL

SEQ ID NO: 2832 - protein, 691 aa, synthetic construct
  REGION 1..691: note = PCDHB1 (Q9Y5F3) SP+PP+ECD
MAGTRRKSLQNRQVGSLLIFLCISVGDATTIRYSVAEEMESGSFVANVAKDLGLEVGKLAARGARLVSEGNKMHFRLHRKTGDLFVKEKLDRESLCGKADPCVLHFEVVLVEPLQSFRAEVRVFDINDNAPVFLNKEPLLKIPESTPLGSRFPLQSAQDLDVGLNGLQNYTLSANGYFHLHTRFCSHGPKYAELVLNKPLDREEQPEVNLTITAVDGGSPPKSGTAHIHVVVLDVNDHVPQFSRLVYRAQVSENSPNGSLVATVTAVDLDEGTNKAITYSLAQNPEAILKTFQIDPQNGEVRLRGPLDFEAIETYDIDIQATDGGGLSAHSKVLVEVVDVNDNPPEVMVSSVSSPLPEDSPPQTVVALFTIRDRDIRVGGKVTCFLREDLPFVIKPTFGNSYSLVTDRSLDREEVSGYNITIVAMDTGPPSLSAETMIEVLISDVNDNPPIFREDSYILTVRENNSPAVFIGKVHAEDLDLGENAQITYSLLPPKNGDLSVFAYISINSGNGKLYALRTMDYEAIQDFQFVVKATDGGFLSLSSQVTVRVVVLDDNDNRPMILYPLQNGTLPCNDLVPRSAEAGYLVTKVVAVDGDSGQNSWLSYHLLKATDLGLFSVQRQNGEIHTLRQISERDPMMQKLIILVQDHGQPALSTTVSLNILLVDGFSEPYLQFQDPTKHSRKVNPSTKYL

SEQ ID NO: 2833 - protein, 692 aa, synthetic construct
  REGION 1..692: note = PCDHB10 (Q9UN67) SP+PP+ECD
MAVRELCFPRQRQVLFLFLFWGVSLAGSGFGRYSVTEETEKGSFVVNLAKDLGLAEGELAARGTRVVSDDNKQYLLLDSHTGNLLTNEKLDREKLCGPKEPCMLYFQILMDDPFQIYRAELRVRDINDHAPVFQDKETVLKISENTAEGTAFRLERAQDPDGGLNGIQNYTISPNSFFHINISGGDEGMIYPELVLDKALDREEQGELSLTLTALDGGSPSRSGTSTVRIVVLDVNDNAPQFAQALYETQAPENSPIGFLIVKVWAEDVDSGVNAEVSYSFFDASENIRTTFQINPFSGEIFLRELLDYELVNSYKINIQAMDGGGLSARCRVLVEVLDTNDNPPELIVSSFSNSVAENSPETPLAVFKINDRDSGENGKMVCYIQENLPFLLKPSVENFYILITEGALDREIRAEYNITITVTDLGTPRLKTEHNITVLVSDVNDNAPAFTQTSYTLFVRENNSPALHIGSVSATDRDSGTNAQVTYSLLPPQDPHLPLASLVSINADNGHLFALRSLDYEALQAFEFRVGATDRGSPALSREALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHLLLVDGFSQPYLPLPEAAPAQAQAEADLLTVYL

SEQ ID NO: 2834 - protein, 690 aa, synthetic construct
  REGION 1..690: note = PCDHB11 (Q9Y5F2) SP+PP+ECD
MENQGTRTQQIRQVLLLFVLLGMSQAGSETWSFSVAEEMQSGSFVGNLAKDLGLKVRELSSRGARVVSNDKKQRLQLDINTGDLLLSETLDREELCGSIEPCVLHLQVLMQNPTQFLQIELQVRDINDHSPIFSEKQMLLEIPENSPVGAVFLLESAKDLDVGINAVKSYTISPNSHFHIKMRVIPDNRKYPELVLDKALDYEELPELSFILSALDGGSPPRSGTALVRVVVVDINDNSPEFEQAFYEVKIRENSILGSLILIVSAWDLDSGTNGEICYTFSHASEDIRKTFEINQKSGEITLRAPLDFETIESYSIIIQATDGGGLFGKSTVIIHVIDVNDNAPEITVSSITSPIPENTPETVVMVFSIQDIDSGDNGRIVCSIPEDLPFVLKSSVENYYTLETERPLDRESTAEYNITITVTDLGIPRLKTEHNTTVLVSDVNDNAPTFTQTSYTLFVRENNSPALHIGSVSATDRDSGTNAQVNYSLLPPQDLHLPLASLVSINTDNGHLFALRSLDYEALQAFDFRVGATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLQVLLVDGFSQPYLPLPEAAPAQAQADSLTVYL

SEQ ID NO: 2835 - protein, 690 aa, synthetic construct
  REGION 1..690: note = PCDHB12 (Q9Y5F1) SP+PP+ECD
MENGGAGTLQIRQVLLFFVLLGMSQAGSETGNFLVMEELQSGSFVGNLAKTLGLEVSELSSRGARVVSNDNKECLQLDTNTGDLLLREMLDREELCGSNEPCVLYFQVLMKNPTQFLQIELQVRDINDHSPVFLEKEMLLEIPENSPVGAVFLLESAKDLDVGINAVKSYTINPNSHFHVKIRVNPDNRKYPELVLDKALDYEERPELSFILTALDGGSPPRSGTALVRVVVVDINDNSPEFEQAFYEVKILENSILGSLVVTVSAWDLDSGTNSELSYTFSHASEDIRKTFEINQKSGDITLTAPLDFEAIESYSIIIQATDGGGLFGKSTVRIQVMDVNDNAPEITVSSITSPIPENTPETVVMVFRIRDRDSGDNGKMVCSIPEDIPFVLKSSVNNYYTLETERPLDRESRAEYNITITVTDLGTPRLKTEHNITVLVSDVNDNAPAFTQTSYALFVRENNSPALHIGSISATDRDSGTNAQVNYSLLPSQDPHLPLASLVSINADNGHLFALRSLDYEALQGFQFRVGATDHGSPALSSEALVRVLVLDANDNSPFVLYPLQNGSAPCTELVPWAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYL

SEQ ID NO: 2836 - protein, 690 aa, synthetic construct
  REGION 1..690: note = PCDHB13 (Q9Y5F0) SP+PP+ECD
MEASGKLICRQRQVLFSFLLLGLSLAGAAEPRSYSVVEETEGSSFVTNLAKDLGLEQREFSRRGVRVVSRGNKLHLQLNQETADLLLNEKLDREDLCGHTEPCVLRFQVLLESPFEFFQAELQVIDINDHSPVFLDKQMLVKVSESSPPGTTFPLKNAEDLDVGQNNIENYIISPNSYFRVLTRKRSDGRKYPELVLDKALDREEEAELRLTLTALDGGSPPRSGTAQVYIEVLDVNDNAPEFEQPFYRVQISEDSPVGFLVVKVSATDVDTGVNGEISYSLFQASEEIGKTFKINPLTGEIELKKQLDFEKLQSYEVNIEARDAGTFSGKCTVLIQVIDVNDHAPEVTMSAFTSPIPENAPETVVALFSVSDLDSGENGKISCSIQEDLPFLLKSAENFYTLLTERPLDRESRAEYNITITVTDLGTPMLITQLNMTVLIADVNDNAPAFTQTSYTLFVRENNSPALHIRSVSATDRDSGTNAQVTYSLLPPQDPHLPLTSLVSINADNGHLFALRSLDYEALQGFQFRVGASDHGSPALSSEALVRVVVLDANDNSPFVLYPLQNGSAPCTELVPRAAEPGYLVTKVVAVDGDSGQNAWLSYQLLKATELGLFGVWAHNGEVRTARLLSERDAAKHRLVVLVKDNGEPPRSATATLHVLLVDGFSQPYLPLPEAAPTQAQADLLTVYL

SEQ ID NO: 2837 - protein, 686 aa, synthetic construct
  REGION 1..686: note = PCDHB14 (Q9Y5E9) SP+PP+ECD
MEIRGALDLRKRQVLIFLVLLGLSRAGTESAHYSVAEETEIGSFVANLARDLGLGVEELSSREARVVSDDNKKYLHLDLLTGNLLLNEKLDRDELCGSTEPCVLHFQVVLENPLQFFRFELCVKDINDHSPTFLDKEILIKISEGTTVGATFLMESAQDLDVGSNSLQNYTISPNSHFYIKIPDSSDRKIYPELVLDRALDYEQEAELRLTLTAVDGGSPPKSGTTLVLIKVLDINDNAPEFPQSLYEVQVPEDRPLGSWIATISAKDLDAGNYGKISYTFFHASEDIRKTFEINPISGEVNLRSPLDFEVIQSYTINIQATDGGGLSGKCTLLVKVMDINDNPPEVTISSITKRIPENASETLVALFSILDQDSGDNGRMICSIQDNLPFFLKPTFKNFFTLVSEKALDRESQAEYNITITVTDLGTPRLKTEYNITVLLSDVNDNAPTFTQTSYTLFVRENNSPALHIGSVSATDRDSGTNAQVNYSLLPPQDRHLPLASLVSINADNGHLFALRSLDYEALQEFEFRVGATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSL

SEQ ID NO: 2838 - protein, 690 aa, synthetic construct
  REGION 1..690: note = PCDHB15 (Q9Y5E8) SP+PP+ECD
MEPAGERFPEQRQVLILLLLLEVTLAGWEPRRYSVMEETERGSFVANLANDLGLGVGELAERGARVVSEDNEQGLQLDLQTGQLILNEKLDREKLCGPTEPCIMHFQVLLKKPLEVFRAELLVTDINDHSPEFPEREMTLKIPETSSLGTVFPLKKARDLDVGSNNVQNYNISPNSHFHVSTRTRGDGRKYPELVLDTELDREEQAELRLTLTAVDGGSPPRSGTVQILILVLDANDNAPEFVQALYEVQVPENSPVGSLVVKVSARDLDTGTNGEISYSLYYSSQEIDKPFELSSLSGEIRLIKKLDFETMSSYDLDIEASDGGGLSGKCSVSVKVLDVNDNFPELSISSLTSPIPENSPETEVALFRIRDRDSGENGKMICSIQDDVPFKLKPSVENFYRLVTEGALDRETRAEYNITITITDLGTPRLKTEQSITVLVSDVNDNAPAFTQTSYTLFVRENNSPALHIGSVSATDRDSGTNAQVTYSLLPPRDPHLPLTSLVSINTDNGHLFALQSLDYEALQAFEFRVGATDRGFPALSSEALVRVLVLDANDNSPFVLYPLQNGSAPCTELVPRAAEPGYLVTKVVAVDGDSGQNAWLSYQLLKATEPGLFGVWAHNGEVRTARLLSERDVAKHRLVVLVKDNGEPPRSATATLQVLLVDGFSQPYLPLPEAAPAQAQADSLTVYL

SEQ ID NO: 2839 - protein, 690 aa, synthetic construct
  REGION 1..690: note = PCDHB16 (Q9NRJ7) SP+PP+ECD
MEIGWMHNRRQRQVLVFFVLLSLSGAGAELGSYSVVEETERGSFVANLGKDLGLGLTEMSTRKARIISQGNKQHLQLKAQTGDLLINEKLDREELCGPTEPCILHFQVLMENPLEIFQAELRVIDINDHSPMFTEKEMILKIPENSPLGTEFPLNHALDLDVGSNNVQNYKISPSSHFRVLIHEFRDGRKYPELVLDKELDREEEPQLRLTLTALDGGSPPRSGTAQVRIEVVDINDNAPEFEQPIYKVQIPENSPLGSLVATVSARDLDGGANGKISYTLFQPSEDISKTLEVNPMTGEVRLRKQVDFEMVTSYEVRIKATDGGGLSGKCTLLLQVVDVNDNPPQVTMSALTSPIPENSPEIVVAVFSVSDPDSGNNGKTISSIQEDLPFLLKPSVKNFYTLVTERALDREARAEYNITLTVTDMGTPRLKTEHNITVQISDVNDNAPTFTQTSYTLFVRENNSPALHIGSVSATDRDSGTNAQVTYSLLPPQDPHLPLASLVSINADNGHLFALRSLDYEALREFEFRVSATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKQRLVVLVKDNGEPPRSATATLHVLLVDGFSQPFLPLPEAAPGQTQANSLTVYL

SEQ ID NO: 2840 - protein, 692 aa, synthetic construct
  REGION 1..692: note = PCDHB2 (Q9Y5E7) SP+PP+ECD
MEAGEGKERVPKQRQVLIFFVLLGIAQASCQPRHYSVAEETESGSFVANLLKDLGLEIGELAVRGARVVSKGKKMHLQFDRQTGDLLLNEKLDREELCGPTEPCVLPFQVLLENPLQFFQAELRIRDVNDHSPVFLDKEILLKIPESITPGTTFLIERAQDLDVGTNSLQNYTISPNFHFHLNLQDSLDGIILPQLVLNRALDREEQPEIRLTLTALDGGSPPRSGTALVRIEVVDINDNVPEFAKLLYEVQIPEDSPVGSQVAIVSARDLDIGTNGEISYAFSQASEDIRKTFRLSAKSGELLLRQKLDFESIQTYTVNIQATDGGGLSGTCVVFVQVMDLNDNPPELTMSTLINQIPENLQDTLIAVFSVSDPDSGDNGRMVCSIQDDLPFFLKPSVENFYTLVISTALDRETRSEYNITITVTDFGTPRLKTEHNITVLVSDVNDNAPAFTQTSYTLFVRENNSPALHIGSVSATDRDSGTNAQVTYSLLPPQDPHLPLASLVSINADNGHLFALQSLDYEALQAFEFRVGAADRGSPALSSEALVRVLVLDANDNSPFVLYPLQNGSAPCTELVPRAAEPGYLVTKVVAVDGDSGQNAWLSYQLLKATEPGLFGVWAHNGEVRTARLLRERDAAKQRLVVLVKDNGEPPRSATATLHVLLVDGFSQPYLLLPEAAPAQAQADLLTVYL

SEQ ID NO: 2841 - protein, 690 aa, synthetic construct
  REGION 1..690: note = PCDHB3 (Q9Y5E6) SP+PP+ECD
MEAGGERFLRQRQVLLLFVFLGGSLAGSESRRYSVAEEKEKGFLIANLAKDLGLRVEELAARGAQVVSKGNKQHFQLSHQTGDLLLNEKLDREELCGPTEPCILHFQILLQNPLQFVTNELRIIDVNDHSPVFFENEMHLKILESTLPGTVIPLGNAEDLDVGRNSLQNYTITPNSHFHVLTRSRRDGRKYPELVLDKALDPEEQPELSLTLTALDGGSPPRSGTAQINIQVLDINDNAPEFAQPLYEVAVLENTPVNSVIVTVSASDLDTGSFGTISYAFFHASEEIRKTFQLNPITGDMQLVKYLNFEAINSYEVDIEAKDGGGLSGKSTVIVQVVDVNDNPPELTLSSVNSPIPENSGETVLAVFSVSDLDSGDNGRVMCSIENNLPFFLKPSVENFYTLVSEGALDRETRSEYNITITITDLGTPRLKTKYNITVLVSDVNDNAPAFTQISYTLFVRENNSPALHIGSVSATDRDSGTNAQVTYSLLPPQDPHLPLSSLVSINADNGHLFALRSLDYEALQAFEFRVGATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADLLTVYL

SEQ ID NO: 2842 - protein, 689 aa, synthetic construct
  REGION 1..689: note = PCDHB4 (Q9Y5E5) SP+PP+ECD
MKKLGRIHPNRQVLAFILMVFLSQVRLEPIRYSVLEETESGSFVAHLAKDLGLGIGELASRSARVLSDDDKQRLQLDRQTGDLLLREKLDREELCGPIEPCVLHFQVFLEMPVQFFQGELLIQDINDHSPIFPEREVLLKILENSQPGTLFPLLIAEDLDVGSNGLQKYTISPNSHFHILTRNHSEGKKYPDLVQDKPLDREEQPEFSLTLVALDGGSPPRSGTVMVRILIMDINDNAPEFVHTPYGVQVLENSPLDSPIVRVLARDIDAGNFGSVSYGLFQASDEIKQTFSINEVTGEILLKKKLDFEKIKSYHVEIEATDGGGLSGKGTVVIEVVDVNDNPPELIISSLTSSIPENAPETVVSIFRIRDRDSGENGKMICSIPDNLPFILKPTLKNFYTLVTERPLDRETSAEYNITIAVTDLGTPRLKTQQNITVQVSDVNDNAPAFTQTSYTLFVRENNSPALHIGSVSATDRDSGTNAQVTYSLLPPQDPHLPLASLVSINADNGHLFALRSLDYEALQAFEFRVGASDRGSPALSSEALVRVLVLDTNDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYL

SEQ ID NO: 2843 - protein, 689 aa, synthetic construct
  REGION 1..689: note = PCDHB5 (Q9Y5E4) SP+PP+ECD
METALAKTPQKRQVMFLAILLLLWEAGSEAVRYSIPEETESGYSVANLAKDLGLGVGELATRGARMHYKGNKELLQLDIKTGNLLLYEKLDREVMCGATEPCILHFQLLLENPVQFFQTDLQLTDINDHAPEFPEKEMLLKIPESTQPGTVFPLKIAQDFDIGSNTVQNYTISPNSHFHVATHNRGDGRKYPELVLDKALDREERPELSLTLTALDGGAPPRSGTTTIRIVVLDNNDNAPEFLQSFYEVQVPENSPLNSLVVVVSARDLDAGAYGSVAYALFQGDEVTQPFVIDEKTAEIRLKRALDFEATPYYNVEIVATDGGGLSGKCTVAIEVVDVNDNAPELTMSTLSSPTPENAPETVVAVFSVSDPDSGDNGRMICSIQNDLPFLLKPTLKNFYTLVTQRTLDRESQAEYNITITVTDMGTPRLKTEHNITVLVSDVNDNAPAFTQTSYTLFVRENNSPALHIGSVSATDRDSGTNAQVTYSLLPPQNPHLRLASLVSINADNGHLFALRSLDYEALQAFEFRVGATDRGSPALSSEALVRVLVLDANDNSPFVLYPLQNGSAPCTELVPRAAEPGYLVTKVVAVDGDSGQNAWLSYQLLKATEPGLFSMWAHNGEVRTARLLSERDAAKHRLVVLVKDNGEPPRSATATLHVLLVDGFSQPYLPLPEAAPAQAQADSLTVYL

SEQ ID NO: 2844 - protein, 688 aa, synthetic construct
  REGION 1..688: note = PCDHB6 (Q9Y5E3) SP+PP+ECD
MMQTKVQNKKRQVAFFILLMLWGEVGSESIQYSVLEETESGTFVANLTKDLGLRVGELASRGARVVFKGNRQHLQFDPQTHDLLLNEKLDREELCGSTEPCVLPFQVLLENPLQFFQASLRVRDINDHAPEFPAREMLLKISEITMPGKIFPLKMAHDLDTGSNGLQRYTISSNPHFHVLTRNRSEGRKFPELVLDKPLDREEQPQLRLTLIALDGGSPPRSGTSEIQIQVLDINDNVPEFAQELYEAQVPENNPLGSLVITVSARDLDAGSFGKVSYALFQVDDVNQPFEINAITGEIRLRKALDFEEIQSYDVDVEATDGGGLSGKCSLVVRVLDVNDNAPELTMSFFISLIPENLPEITVAVFSVSDADSGHNQQVICSIENNLPFLLRPSVENFYTLVTEGALDRESRAEYNITITVTDLGTPRLKTQQSITVQVSDVNDNVPAFTQTSYTLFVRENNSPALHIGSVSATDRDSGINAQVTYSLLPPQDPHLPLSSLVSINADNGHLFALRSLDYEALQSFEFRVGATDRGSPALSSEALVRLLVLDANDNSPFVLYPLQNGSAPCTELVPRAAEPGYLVTKVVAVDGDSGQNAWLSYQLLKATELGLFGVWAHNGEVRTARLLSERDAAKHRLVVLVKDNGEPPRSATATLHVLLVDGFSQPYLPLPEAAPAQAQADSLTVYL

SEQ ID NO: 2845 - protein, 688 aa, synthetic construct
  REGION 1..688: note = PCDHB7 (Q9Y5E2) SP+PP+ECD
MEARVERAVQKRQVLFLCVFLGMSWAGAEPLRYFVAEETERGTFLTNLAKDLGLGVGELRARGTRIVSDQNMQILLLSSLTGDLLLNEKLDREELCGPREPCVLPFQLLLEKPFQIFRAELWVRDINDHAPVFLDREISLKILESTTPGAAFLLESAQDSDVGTNSLSNYTISPNAYFHINVHDSGEGNIYPELVLNQVLDREEIPEFSLTLTALDGGSPPRSGTALVRILVLDVNDNAPDFVRSLYKVQVPENSPVGSMVVSVSARDLDTGSNGEIAYAFSYATERILKTFQINPTSGSLHLKAQLDYEAIQTYTLTIQAKDGGGLSGKCTVVVDVTDINDNRPELLLSSLTSPIAENSPETVVAVFRIRDRDSGNNGKTVCSIQDDVPFILKPSVENFYTLVTEKPLDRERNTEYNITITVTDLGTPRLKTEHNITVLVSDVNDNAPAFTQTSYTLFVRENNSPALPIGSVSATDRDSGTNAQVIYSLLPSQDPHLPLASLVSINADNGHLFALRSLDYEALQAFEFRVGATDRGSPALSSEALVRVLVLDANDNSPFVLYPLQNSSAPCTEPLPRAAEPGYLVTKVVAVDGDSGQNAWLSYQLLKATEPGLFGVWAHNGEVRTARLLSERDAAKQRLVVLVKDNGEPPRSATATLHVLLVDGFSQPYLRLPEAAPDQANSLTVYL

SEQ ID NO: 2846 - protein, 691 aa, synthetic construct
  REGION 1..691: note = PCDHB8 (Q9UN66) SP+PP+ECD
MEASGKLICRQRQVLFSFLLLGLSLAGAAEPRSYSVVEETEGSSFVTNLAKDLGLEQREFSRRGVRVVSRGNKLHLQLNQETADLLLNEKLDREDLCGHTEPCVLRFQVLLESPFEFFQAELQVIDINDHSPVFLDKQMLVKVSESSPPGTAFPLKNAEDLDIGQNNIENYIISPNSYFRVLTRKRSDGRKYPELVLDKALDREEEAELRLTLTALDGGSPPRSGTAQVYIEVVDVNDNAPEFEQPFYRVQISEDSPISFLVVKVSATDVDTGVNGEISYSLFQASDEISKTFKVDFLTGEIRLKKQLDFEKFQSYEVNIEARDAGGFSGKCTVLIQVIDVNDHAPEVTMSAFTSPIPENAPETVVALFSVSDLDSGENGKISCSIQEDLPFLLKSSVGNFYTLLTETPLDRESRAEYNVTITVTDLGTPRLTTHLNMTVLVSDVNDNAPAFTQTSYTLFVRENNSPALHIGSVSATDRDSGTNAQVTYSLLPPQDPHLPLASLVSINTDNGHLFALRSLDYEALQAFEFRVGASDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKQRLVVLVKDNGEPPCSATATLHVLLVDGFSQPYLPLPEAAPAQGQADSLTVYL

SEQ ID NO: 2847 - protein, 690 aa, synthetic construct
  REGION 1..690: note = PCDHB9 (Q9Y5E1) SP+PP+ECD
MKTRGFSFPRQRQVLFLFLFWGVSLAGSGFGRYSVTEETEKGSFVVNLAKDLGLAEGELAARGTRVVSDDNKQYLLLDSHTGNLLTNEKLDREKLCGPKEPCMLYFQILMDDPFQIYRAELRVRDINDHSPVFRHKEMVLKISENTAEGTAFRLERAQDPDEGHNSIQNYTISSNSFFHIKISGSDEGMIYPELVLDKALDREEQEELSLTLTALDGGSPSRSGTSTIRIVVLDVNDNAPQFAQALYETQAPENSPVGSLIVKVSAGDADSGVNAEVSYSFFDASEDILTTFQINPFSGEIFLRELLDYELVNSYKINIQAMDGGGLSARCTVLIKVLDSNDNPPELIISSLSNSVAENSPGIVLAVFKIKDRDSGENGKTICYVQDNLPFFLKPSVDNFYILMTEGALDRESKAEYNITITVTDLGTPRLKTEHSITLQVSDVNDNAPAFTQTSYTLFVRENNSPALHIGSVSATDRDSGTNAQVTYSLLPPQDPHLPLASLVSINADNGHLFALRSLDYEALQAFDFRVGASDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADLLTVYL

SEQ ID NO: 2848 - protein, 692 aa, synthetic construct
  REGION 1..692: note = PCDHGA1 (Q9Y5H4) SP+PP+ECD
MKIQKKLTGCSRLMLLCLSLELLLEAGAGNIHYSVPEETDKGSFVGNIAKDLGLQPQELADGGVRIVSRGRMPLFALNPRSGSLITARRIDREELCAQSMPCLVSFNILVEDKMKLFPVEVEIIDINDNTPQFQLEELEFKMNEITTPGTRVSLPFGQDLDVGMNSLQSYQLSSNPHFSLDVQQGADGPQHPEMVLQSPLDREEEAVHHLILTASDGGEPVRSGTLRIYIQVVDANDNPPAFTQAQYHINVPENVPLGTQLLMVNATDPDEGANGEVTYSFHNVDHRVAQIFRLDSYTGEISNKEPLDFEEYKMYSMEVQAQDGAGLMAKVKVLIKVLDVNDNAPEVTITSVTTAVPENFPPGTIIALISVHDQDSGDNGYTTCFIPGNLPFKLEKLVDNYYRLVTERTLDRELISGYNITITAIDQGTPALSTETHISLLVTDINDNSPVFHQDSYSAYIPENNPRGASIFSVRAHDLDSNENAQITYSLIEDTIQGAPLSAYLSINSDTGVLYALRSFDYEQFRDMQLKVMARDSGDPPLSSNVSLSLFLLDQNDNAPEILYPALPTDGSTGVELAPLSAEPGYLVTKVVAVDRDSGQNAWLSYRLLKASEPGLFSVGLHTGEVRTARALLDRDALKQSLVVAVQDHGQPPLSATVTLTVAVADRISDILADLGSLEPSAKPNDSDLTLY

SEQ ID NO: 2849 - protein, 696 aa, synthetic construct
  REGION 1..696: note = PCDHGA10 (Q9Y5H3) SP+PP+ECD
MAAQRNRSKESKDCSGLVLLCLFFGIPWEAGARQISYSIPEELEKGSFVGNISKDLGLAPRELAERGVRIVSRGRTQLFSLNPRSGSLITAGRIDREELCAQSARCVVSFNILVEDRVKLFGIEIEVTDINDNAPKFQAENLDVKINENVAAGMRFPLPEAIDPDVGVNSLQSYQLSPNKHFSLRVQSRANGVKYPELVLEHSLDREEEAIHHLVLTASDGGDPLRSGTVLVSVTVFDANDNAPVFTLPEYRVSVPENLPVGTQLLTVTATDRDEGANGEVTYSFRKLPDTQLLKFQLNKYTGEIKISENLDYEETGFYEIEIQAEDGGAYLATAKVLITVEDVNDNSPELTITSLFSPVTEDSPLGTVVALLNVHDLDSEQNGQVTCSILAYLPFKLEKSIDSYYRLVIHRALDREQVSSYNITVTATDGGSPPLSTEAHFMLQVADINDNPPTFSQVSYFTYIPENNARGASIFSVTALDPDSKENAQIIYSLAEDTIQGVPLSSYISINSDTGVLYALRSFDYEQFHELQMQVTASDSGDPPLSSNVSLSLFVLDQNDNAPEILYPALPTDGSTGVELAPRSAEPGYLVTKVVAVDRDSGQNAWLSYRLLKASEPGLFAVGEHTGEVRTARALLDRDALKQSLVVAVQDHGQPPLSATVTLTVAVADSIPQVLADLGSFESPANSETSDLTLY

SEQ ID NO: 2850 - protein, 693 aa, synthetic construct
  REGION 1..693: note = PCDHGA11 (Q9Y5H2) SP+PP+ECD
MANRLQRGDRSRLLLLLCIFLGTLRGFRARQIRYSVPEETEKGSFVGNISKDLGLEPRELAKRGVRIVSRGKTQLFAVNPRSGSLITAGRIDREELCETVSSCFLNMELLVEDTLKIYGVEVEIIDINDNAPSFQEDEVEIKVSEHAIPGARFALPNARDPDVGVNSLQSYQLSPNNYFSLQLRGRTDGAKNPELVLEGSLDREKEAAHLLLLTALDGGDPIRKGAVPIRVVVLDVNDHIPMFTQSVYRVSVPENISSGTRVLMVNATDPDEGINGEVMYSFRNMESKASEIFQLDSQTGEVQVRGSLDFEKYRFYEMEIQGQDGGGLFTTTTMLITVVDVNDNAPEITITSSINSILENSPPGTVIALLNVQDQDSGENGQVSCFIPNHLPFKLEKTYGNYYKLITSRVLDRELVQSYNITLTATDQGSPPLSAETHVWLNVADDNDNPPVFPHSSYSAYIPENNPRGASIFSVTALDPDSKQNALVTYSLTDDTVQGVPLSSYVSINSNTGVLYALQSFDYEQFRDLELRVIARDSGDPPLSSNVSLSLFVLDQNDNAPEILYPALPTDGSTGVELAPRSAEPGYLVTKVVAVDKDSGQNAWLSYRLLKASEPGLFAVGEHTGEVRTARALLDRDALKQSLVVAVQDHGQPPLSATVTLTVAVADSIPEVLADLGSLESLANSETSDLSLY

SEQ ID NO: 2851 - protein, 692 aa, synthetic construct
  REGION 1..692: note = PCDHGA12 (O60330) SP+PP+ECD
MIPARLHRDYKGLVLLGILLGTLWETGCTQIRYSVPEELEKGSRVGDISRDLGLEPRELAERGVRIIPRGRTQLFALNPRSGSLVTAGRIDREELCMGAIKCQLNLDILMEDKVKIYGVEVEVRDINDNAPYFRESELEIKISENAATEMRFPLPHAWDPDIGKNSLQSYELSPNTHFSLIVQNGADGSKYPELVLKRALDREEKAAHHLVLTASDGGDPVRTGTARIRVMVLDANDNAPAFAQPEYRASVPENLALGTQLLVVNATDPDEGVNAEVRYSFRYVDDKAAQVFKLDCNSGTISTIGELDHEESGFYQMEVQAMDNAGYSARAKVLITVLDVNDNAPEVVLTSLASSVPENSPRGTLIALLNVNDQDSEENGQVICFIQGNLPFKLEKSYGNYYSLVTDIVLDREQVPSYNITVTATDRGTPPLSTETHISLNVADTNDNPPVFPQASYSAYIPENNPRGVSLVSVTAHDPDCEENAQITYSLAENTIQGASLSSYVSINSDTGVLYALSSFDYEQFRDLQVKVMARDNGHPPLSSNVSLSLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADSIPQVLADLGSLESPANSETSDLTLY

SEQ ID NO: 2852 - protein, 692 aa, synthetic construct
  REGION 1..692: note = PCDHGA2 (Q9Y5H1) SP+PP+ECD
MAALQKLPHCRKLVLLCFLLATLWEARAGQIRYSVREEIDRGSFVGNIAKDLGLEPLALAEQGVRIVSRGRSQLFALNPRSGSLVTANRIDREELCAQSAPCLLNFNILLEDKLTIYSVEVEITDINDNAPRFGVEELELKISETTTPGFRIPLKNAHDADVGENALQKYALNPNDHFSLDVRRGADGNKYPELVLERSLDREEEAVHHLVLVASDGGDPVLSGTSRICVKVLDANDNAPVFTQPEYRISIPENTLVGTRILTVTATDADEGYYAQVVYFLEKSPGETSEVFELKSTSGELTIIKDLDYEDATFHEIDIEAQDGPGLLTRAKVIVTVLDVNDNAPEFYMTSATSSVSEDSLPGTIIGLFNVHDRDSGQNAFTTCSLPEDLPFKLEKSVDNYYRLVTTRALDREQFSFYNITLTAKDGGNPSLSTDAHILLQVADINDNAPAFSRTSYSTYIPENNPRGASVFSVTAHDPDSNDNAHVTYSFAEDTVQGAPLSSYISINSDTGVLYALRSFDYEQLRDLQVWVIARDSGNPPLSSNVSLSLFVLDQNDNAPEILYPAFPTDGSTGVELAPRSAEPGYLVTKVVAVDRDSGQNAWLSYHLLKASEPGLFSVGLHTGEVRTARALLDRDALKQSLVVAIQDHGQPPLSATVTLTVAVADRIPDILADLGSLEPSAIPNDSDLTLY

SEQ ID NO: 2853 - protein, 692 aa, synthetic construct
  REGION 1..692: note = PCDHGA3 (Q9Y5H0) SP+PP+ECD
MTNCLSFRNGRGLALLCALLGTLCETGSGQIRYSVSEELDKGSFVGNIANDLGLEPRELAERGVRIVSRGRTQLFSLNPQSGSLVTAERIDREELCAQIPLCLVKINILVEDKLKIFEVEIEIKDINDNAPNFPTEELEIKIGELTVPGTRFPIKTAFDPDVGINSLQNYKLSPNDYFSLAVNSVSEGAKYPELVLERALDREKKEIHQLVLVASDGGDPVHSGNLHIQVIVLDANDNPPMFTQPEYRVSVWENVPVGTRLLTVNATDPDEGFNAQVSYILDKMPGKIAEIFHLNSVSGEVSILKSLDYEDAMFYEIKIEAQDGPGLLSRAKILVTVLDVNDNAPEITITSLTSSVPEEGTVGREIALIDVHDRDSGQNGQVEVFVLGNLPFKLEKSIDQYYRLVTATSLDREQISEYNISLRASDGGSPPLSTETHITLHVIDINDNPPTFPHLSYSAYIPENNPRGASIFSVTAQDPDSNNNARITYALTEDTLQGAPLSSFVSINSNTGVLYALRSFDYEQFRDLKLLVTASDSGNPPLSSNVSLNLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADRIPDILADLGSLEPSAKPNDSDLTLY

SEQ ID NO: 2854 - protein, 723 aa, synthetic construct
  REGION 1..723: note = PCDHGA4 (Q9Y5G9) SP+PP+ECD
MHFILDPEDPGAPQASTEGKPKHRRLRGGVVMAAPPARPDHTRLLQICLLLGVLVEIRAEQILYSVFEEQEEGSVVGNIAKDLGLAPRELAERGVRIVSRGRTQLFALNPRSGTLVTAGRIDREELCDRSPNCVTNLEILLEDTVKILRVEVEIIDVNDNPPSFGTEQREIKVAENENPGARFPLPEAFDPDVGVNSLQGYQLNSNGYFSLDVQSGADGIKYPELVLERALDREEEAVHHLVLTAFDGGDPVRSGTARILIILVDTNDNAPVFTQPEYHVSVRENVPVGTRLLTVKATDPDEGANGDVTYSFRKVRDKISQLFQLNSLSGDITILGGLDYEDSGFYDIDVEAHDGPGLRARSKVLVTVLDENDNAPEVTVTSLTSSVQESSSPGTVIALFNVHDSDSGGNGLVTCSIPDNLPFTLEKTYGNYYRLLTHRTLDREEVSEYNITVTATDQGTPPLSTETHISLQVMDINDNPPTFPHASYSAYIPENNPRGASILSMTAQDPDSGDNARITYSLAEDTFQGAPLSSYVSINSNTGILYALCSFDYEQFRDLQLLMTASDSGDPPLSSNVSLSLFVLDQNDNVPEILYPTFPTDGSTGVELAPRSADSGYLVTKVVAVDRDSGQNAWLSYSLLKSSEPGLFAVGLHTGEVRTARALLDRDALKQRLVVVVQDHGQPPLSATVTLTVAVADSIPDVLADLGSLKPSADPDDSGLTLY

SEQ ID NO: 2855 - protein, 692 aa, synthetic construct
  REGION 1..692: note = PCDHGA5 (Q9Y5G8) SP+PP+ECD
MASPPRGWGCGELLLPFMLLGTLCEPGSGQIRYSMPEELDKGSFVGNIAKDLGLEPQELAERGVRIVSRGRTQLFALNPRSGSLVTAGRIDREELCAQSPLCVVNFNILVENKMKIYGVEVEIIDINDNFPRFRDEELKVKVNENAAAGTRLVLPFARDADVGVNSLRSYQLSSNLHFSLDVVSGTDGQKYPELVLEQPLDREKETVHDLLLTALDGGDPVLSGTTHIRVTVLDANDNAPLFTPSEYSVSVPENIPVGTRLLMLTATDPDEGINGKLTYSFRNEEEKISETFQLDSNLGEISTLQSLDYEESRFYLMEVVAQDGGALVASAKVVVTVQDVNDNAPEVILTSLTSSISEDCLPGTVIALFSVHDGDSGENGEIACSIPRNLPFKLEKSVDNYYHLLTTRDLDREETSDYNITLTVMDHGTPPLSTESHIPLKVADVNDNPPNFPQASYSTSVTENNPRGVSIFSVTAHDPDSGDNARVTYSLAEDTFQGAPLSSYVSINSDTGVLYALRSFDYEQLRDLQLWVTASDSGNPPLSSNVSLSLFVLDQNDNTPEILYPALPTDGSTGVELAPRSAEPGYLVTKVVAVDKDSGQNAWLSYRLLKASEPGLFAVGLHTGEVRTARALLDRDALKQSLVVAVEDHGQPPLSATFTVTVAVADRIPDILADLGSIKTPIDPEDLDLTLY

SEQ ID NO: 2856 - protein, 692 aa, synthetic construct
  REGION 1..692: note = PCDHGA6 (Q9Y5G7) SP+PP+ECD
MAPPQRHPQRSEQVLLLTLLGTLWGAAAAQIRYSIPEELEKGSFVGNIVKDLGLEPQELAEHGVRIVSRGRMQLFSLNPRNGSLVTAGRIDREELCAQSPRCLVSFNILVEDKLNLYPVEVEIVDINDNTPRFLKEELEVKILENAAPSSRFPLMEVYDPDVGMNSLQGFKLSGNSHFSVDVQSEAHGPKYPELVLEGTLDREGEAVYRLVLTAMDGGDPVRSSVAQILVTVLDVNDNTPMFTQPVYRVSVPENLPVGTPVLAVTATDQDEGVHGEVTYSFVKITEKISQIFCLNVLTGEISTSANLDYEDSSFYELGVEARDGPGLRDRAKVLITILDVNDNVPEVVVTSGSRTIAESAPPGTVIALFQVFDRDSGLNGLVTCSIPRSLPFELEKSVGNYYRLVTNAALDREEVFLYNITVTATDKGTPPLSTETIISLNVADTNDNPPTFPHSSYSVYVLENNPRGASIFSVNALDPDVDQNAQVSYSLAEDTLQGAPLSSYVSINSDTGILYALRSFDYEQLRDLQLWVTASDSGDPPLSSNVSLSLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADRIPDILADLGSLEPSAKPNDSDLTLY

SEQ ID NO: 2857 - protein, 692 aa, synthetic construct
  REGION 1..692: note = PCDHGA7 (Q9Y5G6) SP+PP+ECD
MAAQPRGGDYRGFFLLSILLGTPWEAWAGRILYSVSEETDKGSFVGDIAKDLGLEPRELAERGVRIISRGRTQLFALNQRSGSLVTAGRIDREEICAQSARCLVNFNILMEDKMNLYPIDVEIIDINDNVPRFLTEEINVKIMENTAPGVRFPLSEAGDPDVGTNSLQSYQLSPNRHFSLAVQSGDDETKYPELVLERVLDREEERVHHLVLTASDGGDPPRSSTAHIQVTVVDVNDHTPVFSLPQYQVTVPENVPVGTRLLTVHAIDLDEGVNGEVTYSFRKITPKLPKMFHLNSLTGEISTLEGLDYEETAFYEMEVQAQDGPGSLTKAKVLITVLDVNDNAPEVTMTSLSSSIPEDTPLGTVIALFYLQDRDSGKNGEVTCTIPENLPFKLEKSIDNYYRLVTTKNLDRETLSLYNITLKATDGGTPPLSRETHIFMQVADTNDNPPTFPHSSYSVYIAENNPRGASIFLVTAQDHDSEDNAQITYSLAEDTIQGAPVSSYVSINSDTGVLYALQSFDYEQLRELQLRVTAHDSGDPPLSSNMSLSLFVLDQNDNPPEILYPALPTDGSTGMELAPRSAEPGYLVTKVVAVDKDSGQNAWLSYLLLKASEPGLFAVGLYTGEVRTARALLDRDALKQSLVVAVQDHGQPPLSATVTLTVAVADSIPEVLADLGSLEPSDGPYNYDLTLY

SEQ ID NO: 2858 - protein, 692 aa, synthetic construct
  REGION 1..692: note = PCDHGA8 (Q9Y5G5) SP+PP+ECD
MAAPQSRPRRGELILLCALLGTLWEIGRGQIRYSVPEETDKGSFVGNISKDLGLDPRKLAKHGVRIVSRGRTQLFALNPRSGSLITAGRIDREELCAQSPRCLININTLVEDKGKLFGVEIEIIDINDNNPKFQVEDLEVKINEIAVPGARYPLPEAVDPDVGVNSLQSYQLSPNHHFSLDVQTGDNGAINPELVLERALDREEEAAHHLVLTASDGGKPPRSSTVRIHVTVLDTNDNAPVFPHPIYRVKVLENMPPGTRLLTVTASDPDEGINGKVAYKFRKINEKQTPLFQLNENTGEISIAKSLDYEECSFYEMEIQAEDVGALLGRTKLLISVEDVNDNRPEVIITSLFSPVLENSLPGTVIAFLSVHDQDSGKNGQVVCYTRDNLPFKLEKSIGNYYRLVTRKYLDRENVSIYNITVMASDLGTPPLSTETQIALHVADINDNPPTFPHASYSAYILENNLRGASIFSLTAHDPDSQENAQVTYSVTEDTLQGAPLSSYISINSDTGVLYALQSFDYEQIRDLQLLVTASDSGDPPLSSNMSLSLFVLDQNDNAPEILYPALPTDGSTGVELAPRSAERGYLVTKVVAVDRDSGQNAWLSYRLLKASEPGLFSVGLHTGEVRTARALLDRDALKQSLVVAVQDHGQPPLSATVTLTVAVADSIPEVLTELGSLKPSVDPNDSSLTLY

SEQ ID NO: 2859 - protein, 692 aa, synthetic construct
  REGION 1..692: note = PCDHGA9 (Q9Y5G4) SP+PP+ECD
MAAPTKCQLRGRLVLLCSLLGMLWEARASQIRYSVPEETEKGYIVGNISKDLALEPRELAERRVRIVSRGRTQLFSLNPRSGTLVTAGRIDREELCAQSPRCLVNFKVLVEDRVKLYGIEIEVTDINDSAPKFQAESLEVKINEIAVPGARYPLPEAIDPDVGVNSLQSYQLSPNHHFSLNVQTGDNGAINPELVLERALDREEATAHHLVLTASDGGEPRRSSTVRIHVTVLDTNDNAPVFAQRIYRVKVLENVPPGTWLLTATASDLDEGINGKVAYKFWKINEKQSLLFQLNENTGEISTAKSLDYEECSFYEMEIQAEDGGGLKGWTKVLISVEDVNDNRPEVTITSLFSPVREDAPQGTVILLFNAHDRDSGKNGQVVCSIQENLSFTLENSEEDYYRLLTAQILDREKASEYNITVTATDRGTPPLSTEIHITLQVTDINDNPPAFSQASYSVYLPENNARGTSIFSVIAYDPDSNENSRVIYSLAEDTIQGSPLSTYVSINSDTGVLYALCSFDYEQFRDLQMQVTASDSGSPPLSSNVSLRLFVLDQNDNAPEILYPALPTDGSTGVELAPRSAEPGYLVTKVVAVDRDSGQNAWLSYRLFKASEPGLFSVGLHTGEVRTARALLDRDALKQSLVVAVQDHGQPPLSATVTLTVAIADSIPDILADLGSLQIPADLEASDLTLY

SEQ ID NO: 2860 - protein, 687 aa, synthetic construct
  REGION 1..687: note = PCDHGB1 (Q9Y5G3) SP+PP+ECD
MQRAREAEMMKSQVLFPFLLSLFCGAISQQIRYTIPEELANGSRVGKLAKDLGLSVRELPTRKLRVSAEDYFNVSLESGDLLVNGRIDREKICGRKLECALEFETVAENPMNVFHVVVVIQDINDNAPRFVAKGIDLEICESALPGVKFSLDSAQDADVEGNSLKLYTINPNQYFSLSTKESPDGSKYPVLLLEKPLDREHQSSHRLILTAMDGGDPPLSGTTHIWIRVTDANDNAPVFSQEVYRVSLQENVPWGTSVLRVMATDQDEGINAEITYAFLNSPISTSLFNLNPNTGDITTNGTLDFEETSRYVLSVEAKDGGVHTAHCNVQIEIVDENDNAPEVTFMSFSNQIPEDSDLGTVIALIKVRDKDSGQNGMVTCYTQEEVPFKLESTSKNYYKLVIAGALNREQTADYNVTIIATDKGKPALSSRTSITLHISDINDNAPVFHQASYVVHVSENNPPGASIAQVSASDPDLGPNGRVSYSILASDLEPRELLSYVSVSPQSGVVFAQRAFDHEQLRAFELTLQARDQGSPALSANVSLRVLVGDLNDNAPRVLYPALGPDGSALFDMVPRAAEPGYLVTKVVAVDADSGHNAWLSYHVLQASEPGLFSLGLRTGEVRTARALGDRDAARQRLLVAVRDGGQPPLSATATLHLIFADSLQEVLPDLSDRPEPSDPQTELQFY

SEQ ID NO: 2861 - protein, 691 aa, synthetic construct
  REGION 1..691: note = PCDHGB2 (Q9Y5G2) SP+PP+ECD
MKASSGRCGLVRWLQVLLPFLLSLFPGALPVQIRYSIPEELAKNSVVGNLAKDLGLSVRDLPARKLRVSAEKEYFTVNPESGDLLVSDRIDREQICGKQPLCVLDFDTVAENPLNIFYIAVIVQDINDNTPLFKQTKINLKIGESTKPGTTFPLDPALDSDVGPNSLQRYHLNDNEYFDLAEKQTPDGRKYPELILKHSLDREEHSLHQLVLTAVDGGDPPQSGTTQIRIKVTDANDNPPVFSQDVYRVTLREDVPPGFFVLQVTATDRDEGINAEITYSFHNVDEQVKHFFNLNEKTGEITTKDDLDFEIASSYTLSIEAKDPGDLAAHCSIQVEILDDNDCAPEVIVTSVSTPLPEDSPPGTVIALIKTRDRDSGENGEVYCQVLGNAKFILKSSSKNYYKLVTDGALDREEIPEYNLTITATDGGKPPLSSSIIVTLHISDVNDNAPVFQQTSYMVHVAENNPPGASIAQISASDPDLGPSGQVSYSIVASDLKPREILSYVSVSAQSGVVFAQRAFDHEQLRAFELTLQARDQGSPALSANVSLRVLVGDLNDNAPRVLYPALGPDGSALFDMVPRAAEPGYLVTKVVAVDADSGHNAWLSYHVLQASEPGLFSLGLRTGEVRTARALGDRDAARQRLLVAVRDGGQPPLSATATLHLIFADSLQEVLPDLSDRREPSDPQAKLQFY

SEQ ID NO: 2862 - protein, 691 aa, synthetic construct
  REGION 1..691: note = PCDHGB3 (Q9Y5G1) SP+PP+ECD
MGNSSGWRGPAGQRRMLFLFLLSLLDQALSEPIRYAIPEELDRGSLVGNLAKDLGFGVGDLPTRNLRVIAEKKFFTVSPENGNLLVSDRIDREEICGKKSTCVLEFEMVAEKPLNFFHVTVLIQDINDNPPTFSQNITELEISELALTGATFALESAQDPDVGVNSLQQYYLSPDPHFSLIQKENLDGSRYPELVLKAPLDREEQPHHHLVLTAVDGGEPSRSCTTQIRVIVADANDNPPVFTQDMYRVNVAENLPAGSSVLKVMAIDMDEGINAEIIYAFINIGKEVRQLFKLDSKTGELTTIGELDFEERDSYTIGVEAKDGGHHTAYCKVQIDISDENDNAPEITLASESQHIQEDAELGTAVALIKTHDLDSGFNGEILCQLKGNFPFKIVQDTKNTYRLVTDGALDREQIPEYNVTITATDKGNPPLSSSKTITLHILDVNDNVPVFHQASYTVHVAENNPPGASIAHVRASDPDLGPNGLVSYYIVASDLEPRELSSYVSVSARSGVVFAQRAFDHEQLRAFELTLQARDQGSPTLSANVSLRVLVDDRNDNAPLVLYPALGPEGSALFDMVPRSAEPGYLVTKVVAVDADSGYNAWLSYHIVQASEPGLFSLGLRTGEVRTARTLGDREAARQRLLVTVRDGGQQPLSATVMLHLIFADSLQEIQPDLSDRPTPSDPQAELQFH

SEQ ID NO: 2863 - protein, 689 aa, synthetic construct
  REGION 1..689: note = PCDHGB4 (Q9UN71) SP+PP+ECD
MGSGAGELGRAERLPVLFLFLLSLFCPALCEQIRYRIPEEMPKGSVVGNLATDLGFSVQELPTRKLRVSSEKPYFTVSAESGELLVSSRLDREEICGKKPACALEFEAVAENPLNFYHVNVEIEDINDHTPKFTQNSFELQISESAQPGTRFILGSAHDADIGSNTLQNYQLSPSDHFSLINKEKSDGSKYPEMVLKTPLDREKQKSYHLTLTALDFGAPPLSSTAQIHVLVTDANDNAPVFSQDVYRVSLSENVYPGTTVLQVTATDQDEGVNAEITFSFSEASQITQFDLNSNTGEITVLNTLDFEEVKEYSIVLEARDGGGMIAQCTVEVEVIDENDNAPEVIFQSLPNLIMEDAELGTHIALLKVRDKDSRHNGEVTCKLEGDVPFKILTSSRNTYKLVTDAVLDREQNPEYNITVTATDRGKPPLSSSSSITLHIGDVNDNAPVFSQSSYIVHVAENNPPGASISQVRASDPDLGPNGQVSYCIMASDLEQRELSSYVSISAESGVVFAQRAFDHEQLRAFELTLQARDQGSPALSANVSLRVLVDDRNDNAPRVLYPALGPDGSALFDMVPHAAEPGYLVTKVVAVDADSGHNAWLSYHVLQASEPGLFSLGLRTGEVRTARALGDRDAVRQRLLVAVRDGGQPPLSATATLHLVFADSLQEVLPDITDRPDPSDLQAELQFY

SEQ ID NO: 2864 - protein, 687 aa, synthetic construct
  REGION 1..687: note = PCDHGB5 (Q9Y5G0) SP+PP+ECD
MGSGAGELGRAERLPVLFLFLLSLFCPALCEQIRYRIPEEMPKGSVVGNLATDLGFSVQELPTRKLRVSSEKPYFTVSAESGELLVSSRLDREEICGKKPACALEFEAVAENPLNFYHVNVEIEDINDHTPKFTQNSFELQISESAQPGTRFILEVAEDADIGLNSLQKYKLSLNPSFSLIIKEKQDGSKYPELALEKTLDREQQSYHRLVLTALDGGHPPLSGTTELRIQVTDANDNPPVFNRDVYRVSLRENVPPGTTVLQVSATDQDEGINSEITYSFYRTGQIFSLNSKSGEITTQKKLDFEETKEYSMVVEGRDGGGLVAQCTVEINIQDENDNSPEVTFHSLLEMILENAVPGTLIALIKIHDQDSGENGEVNCQLQGEVPFKIISSSKNSYKLVTDGTLDREQTPEYNVTITATDRGKPPLSSSISVILHIRDVNDNAPVFHQASYLVSVPENNPPGASIAQVCASDLDLGLNGQVSYSIMASDLEPLALASYVSMSAQSGVVFAQRAFDYEQLRTFELTLQARDQGSPALSANVSLRVLVGDRNDNAPRVLYPALGPDGSALFDMVPRAAEPGYLVTKVVAVDADSGHNAWLSYHVLQASEPGLFSLGLRTGEVRTARALGDRDAARQRLLVAVRDGGQPPLSATATLHLVFADSLQEVLPDITDRPVPSDPQAELQFY

SEQ ID NO: 2865 - protein, 691 aa, synthetic construct
  REGION 1..691: note = PCDHGB6 (Q9Y5F9) SP+PP+ECD
MGGSCAQRRRAGPRQVLFPLLLPLFYPTLSEPIRYSIPEELAKGSVVGNLAKDLGLSVLDVSARKLRVSAEKLHFSVDAESGDLLVKNRIDREQICKERRRCELQLEAVVENPLNIFHVIVVIEDVNDHAPQFDKKEIHLEIFESASAGTRLSLDPATDPDININSIKDYKINSNPYFSLMVRVNSDGGKYPELSLEKLLDREEQRSHSLILTALDGGDPPRSATAHIEISVKDTNDNPPVFSRDEYRISLSENLPPGSPVLQVTATDQDEGVNAEINYYFRSTAQSTKHMFSLDEKTGMIKNNQSFDFEDVERYTMEVEAKDGGGLSTQCKVIIEILDENDNSPEIIITSLSDQILENSPPGMVVALFKTRDLDFGGNGEVRCNIETDIPFKIYSSSNNYYKLVTDGALDREQTPEYNVTIVATDRGKPPLSSSRSITLYVADINDNAPVFDQTSYVVHVAENNPPGASIAQVSASDPDLGLNGHISYSIVASDLEPLAVSSYVSVSAQSGVVFAQRAFDHEQLRAFALTLQARDHGSPTLSANVSLRVLVGDRNDNAPRVLYPALGPDGSAFFDMVPRSAEPGYLVTKVVAVDADSGHNAWLSYHVLQASEPGLFSLGLRTGEVRTARALGDRDAARQRLLVAVRDGGQPPLSATATLHLVFADNLQEILPDLSDRPVLSDPQAELQFY

SEQ ID NO: 2866 - protein, 691 aa, synthetic construct
  REGION 1..691: note = PCDHGB7 (Q9Y5F8) SP+PP+ECD
MGGSCAQRRRAGPRQVLFPLLLPLFYPTLCEPIRYSIPEELAKGSVVGNLAKDLGLSVLDVSARELRVSAEKLHFSVDAQSGDLLVKDRIDREQICKERRRCELQLEAVVENPLNIFHVIVVIEDVNDHAPQFRKDEINLEISESVSLGMGTILESAEDPDISMNSLSKYQLSPNEYFSLVEKDNPDGGKYPELVLQKTLDRETQSAHHLVLTALDGGDPPRSGTAQIRILVIDANDNPPVFSQDVYRVSLREDVPPGTSILRVKATDQDEGINSEITYSFFGVADKAQHVFSLDYTTGNILTQQPLDFEEVERYTINIEAKDRGSLSTRCKVIVEVVDENDNSPEIIITSLSDQIMEDSPPGVVVALFKTRDQDSGENGEVRCSLSRGVPFKIHSSSNNYYKLVTDEALDREQTPEYNVTIAATDRGKPPLSSSKTITLHITDVNDNAPVFGQSAYLVHVPENNQPGASIAQVSASDPDFGLNGRVSYSLIASDLESRTLSSYVSVSAQSGVVFAQRAFDHEQLRTFELTLQARDQGSPALSANVSLRVLVGDRNDNAPRVLYPALGPDGSALFDTVPRAAQPGYLVTKVVAVDADSGHNAWLSYHVVQASEPGLFSLGLRTGEVRMVRALGDKDSVRQRLLVAVRDGGQPPLSATATLHLVFADSLQEVLPDFSDHPTPSDSQAEMQFY

SEQ ID NO: 2867 - protein, 693 aa, synthetic construct
  REGION 1..693: note = PCDHGC3 (Q9UN70) SP+PP+ECD
MVPEAWRSGLVSTGRVVGVLLLLGALNKASTVIHYEIPEEREKGFAVGNVVANLGLDLGSLSARRFRVVSGASRRFFEVNRETGEMFVNDRLDREELCGTLPSCTVTLELVVENPLELFSVEVVIQDINDNNPAFPTQEMKLEISEAVAPGTRFPLESAHDPDVGSNSLQTYELSRNEYFALRVQTREDSTKYAELVLERALDREREPSLQLVLTALDGGTPALSASLPIHIKVLDANDNAPVFNQSLYRARVLEDAPSGTRVVQVLATDLDEGPNGEIIYSFGSHNRAGVRQLFALDLVTGMLTIKGRLDFEDTKLHEIYIQAKDKGANPEGAHCKVLVEVVDVNDNAPEITVTSVYSPVPEDAPLGTVIALLSVTDLDAGENGLVTCEVPPGLPFSLTSSLKNYFTLKTSADLDRETVPEYNLSITARDAGTPSLSALTIVRVQVSDINDNPPQSSQSSYDVYIEENNLPGAPILNLSVWDPDAPQNARLSFFLLEQGAETGLVGRYFTINRDNGIVSSLVPLDYEDRREFELTAHISDGGTPVLATNISVNIFVTDRNDNAPQVLYPRPGGSSVEMLPRGTSAGHLVSRVVGWDADAGHNAWLSYSLLGSPNQSLFAIGLHTGQISTARPVQDTDSPRQTLTVLIKDNGEPSLSTTATLTVSVTEDSPEARAEFPSGSAPREQKKNLTFY

SEQ ID NO: 2868 - protein, 692 aa, synthetic construct
  REGION 1..692: note = PCDHGC4 (Q9Y5F7) SP+PP+ECD
MLRKVRSWTEIWRWATLLFLFYHLGYVCGQIRYPVPEESQEGTFVGNVAQDFLLDTDSLSARRLQVAGEVNQRHFRVDLDSGALLIKNPIDREALCGLSASCIVPLEFVTEGPLEMYRAEVEIVDVNDHAPRFPRQQLDLEIGEAAPPGQRFPLEKAQDADVGSNSISSYRLSSNEHFALDVKKRSDGSLVPELLLEKPLDREKQSDYRLVLTAVDGGNPPRSGTAELRVSVLDVNDNAPAFQQSSYRISVLESAPAGMVLIQLNASDPDLGPSGNVTFYFSGHTPDRVRNLFSLHPTTGKLTLLGPLDFESENYYEFDVRARDGGSPAMEQHCSLRVDLLDVNDNAPYITVTSELGTLPESAEPGTVVALISVQDPDSGSNGDVSLRIPDHLPFALKSAFRNQFSLVTAGPLDREAKSSYDIMVTASDAGNPPLSTHRTIFLNISDVNDNPPSFFQRSHEVFVPENNRPGDLLCSLAASDPDSGLNALISYSLLEPRNRDVSASSFISLNPQTGAVHATRSFDYEQTQTLQFEVQARDRGNPPLSSTVTVRLFVLDLNDNAPAVLRPRARPGSLCPQALPPSVGAGHLITKVTAVDLDSGYNAWVSYQLLEAPDPSLFAVSRYAGEVRTAVPIPADLPPQKLVIVVKDSGSPPLSTSVTLLVSLEEDTHPVVPDLRESSAPREGESRLTLY

SEQ ID NO: 2869 - protein, 693 aa, synthetic construct
  REGION 1..693: note = PCDHGC5 (Q9Y5F6) SP+PP+ECD
MGPKTLPQLAGKWQVLCMLSLCCWGWVSGQLRYSVVEESEPGTLVGNVAQDLGLKMTDLLSRRLQLGSEENGRYFSLSLMSGALAVNQKIDRESLCGASTSCLLPVQVVTEHPLELIRVEVEILDLNDNSPSFATPEREMRISESAASGARFPLDSAQDPDVGTNTVSFYTLSPNSHFSLNVKTLKDGKPFPELVLEQQLDREAQARHQLVLTAVDGGTPARSGTTLISVIVLDINDNAPTFQSSVLRVGIPENAPIGTLLLRLNATDPDEGTNGQLDYSFGDHTSEAVRNLFGLDPSSGAIHVLGPIDFEESRFYEIHARARDQGQPAMEGHCVIQVDVGDVNDNAPEVLLASLANPVLESTPVGTVVGLFNVRDRDSGRNGEVSLDISPDLPFQIKPSENHYSLLTSQPLDREATSHYIIELLASDAGSPSLHKHLTIRLNISDVNDNAPRFNQQLYTAYILENRPPGSLLCTVAASDPDTGDNARLTYSIVGNQVQGAPASSFVYVNPEDGRIFAQRTFDYELLQMLQIVVGVRDSGSPPLHANTSLHVFVLDENDNAPAVLHPRPDWEHSAPQRLPRSAPPGSLVTKVTAVDADAGHNAWLSYSLLPQSTAPGLFLVSTHTGEVRTARALLEDDSDTQQVVVLVRDNGDPSLSSTATVLLVLEDEDPEEMPKSSDFLIHPPERSDLTLY

SEQ ID NO: 2870 - protein, 1743 aa, synthetic construct
  REGION 1..1743: note = PCSK5 (Q92824) SP+PP+ECD
MGWGSRCCCPGRLDLLCVLALLGGCLLPVCRTRVYTNHWAVKIAGGFPEANRIASKYGFINIGQIGALKDYYHFYHSRTIKRSVISSRGTHSFISMEPKVEWIQQQVVKKRTKRDYDFSRAQSTYFNDPKWPSMWYMHCSDNTHPCQSDMNIEGAWKRGYTGKNIVVTILDDGIERTHPDLMQNYDALASCDVNGNDLDPMPRYDASNENKHGTRCAGEVAAAANNSHCTVGIAFNAKIGGVRMLDGDVTDMVEAKSVSFNPQHVHIYSASWGPDDDGKTVDGPAPLTRQAFENGVRMGRRGLGSVFVWASGNGGRSKDHCSCDGYTNSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGPCDPECSEVGCDGPGPDHCNDCLHYYYKLKNNTRICVSSCPPGHYHADKKRCRKCAPNCESCFGSHGDQCMSCKYGYFLNEETNSCVTHCPDGSYQDTKKNLCRKCSENCKTCTEFHNCTECRDGLSLQGSRCSVSCEDGRYFNGQDCQPCHRFCATCAGAGADGCINCTEGYFMEDGRCVQSCSISYYFDHSSENGYKSCKKCDISCLTCNGPGFKNCTSCPSGYLLDLGMCQMGAICKDGEYVDEHGHCQTCEASCAKCQGPTQEDCTTCPMTRIFDDGRCVSNCPSWKFEFENQCHPCHHTCQRCQGSGPTHCTSCGADNYGREHFLYQGECGDSCPEGHYATEGNTCLPCPDNCELCHSVHVCTRCMKGYFIAPTNHTCQKLECGQGEVQDPDYEECVPCEEGCLGCSLDDPGTCTSCAMGYYRFDHHCYKTCPEKTYSEEVECKACDSNCGSCDQNGCYWCEEGFFLLGGSCVRKCGPGFYGDQEMGECESCHRACETCTGPGHDECSSCQEGLQLLRGMCVHATKTQEEGKFWNDILRKLQPCHSSCKTCNGSATLCTSCPKGAYLLAQACVSSCPQGTWPSVRSGSCENCTEACAICSGADLCKKCQMQPGHPLFLHEGRCYSKCPEGSYAEDGICERCSSPCRTCEGNATNCHSCEGGHVLHHGVCQENCPERHVAVKGVCKHCPEMCQDCIHEKTCKECTPEFFLHDDMCHQSCPRGFYADSRHCVPCHKDCLECSGPKADDCELCLESSWVLYDGLCLEECPAGTYYEKETKECRDCHKSCLTCSSSGTCTTCQKGLIMNPRGSCMANEKCSPSEYWDEDAPGCKPCHVKCFHCMGPAEDQCQTCPMNSLLLNTTCVKDCPEGYYADEDSNRCAHCHSSCRTCEGRHSRQCHSCRPGWFQLGKECLLQCREGYYADNSTGRCERCNRSCKGCQGPRPTDCLSCDRFFFLLRSKGECHRSCPDHYYVEQSTQTCERCHPTCDQCKGKGALNCLSCVWSYHLMGGICTSDCLVGEYRVGEGEKFNCEKCHESCMECKGPGAKNCTLCPANLVLHMDDSHCLHCCNTSDPPSAQECCDCQDTTDECILRTSKVRPATEHFKT

SEQ ID NO: 2871 - protein, 170 aa, synthetic construct
  REGION 1..170: note = PDCD1 (Q15116) SP+PP+ECD
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLV

SEQ ID NO: 2872 - protein, 220 aa, synthetic construct
  REGION 1..220: note = PDCD1LG2 (Q9BQ51) SP+PP+ECD
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 2873 - protein, 528 aa, synthetic construct
  REGION 1..528: note = PDGFRA (P16234) SP+PP+ECD
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPVTLHNSEGVVPASYDSRQGFNGTFTVGPYICEATVKGKKFQTIPFNVYALKATSELDLEMEALKTVYKSGETIVVTCAVFNNEVVDLQWTYPGEVKGKGITMLEEIKVPSIKLVYTLTVPEATVKDSGDYECAARQATREVKEMKKVTISVHEKGFIEIKPTFSQLEAVNLHEVKHFVVEVRAYPPPRISWLKNNLTLIENLTEITTDVEKIQEIRYRSKLKLIRAKEEDSGHYTIVAQNEDAVKSYTFELLTQVPSSILDLVDDHHGSTGGQTVRCTAEGTPLPDIEWMICKDIKKCNNETSWTILANNVSNIITEIHSRDRSTVEGRVTFAKVEETIAVRCLAKNLLGAENRELKLVAPTLRSELTVA

SEQ ID NO: 2874 - protein, 532 aa, synthetic construct
  REGION 1..532: note = PDGFRB (P09619) SP+PP+ECD
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQVSSINVSVNAVQTVVRQGENITLMCIVIGNEVVNFEWTYPRKESGRLVEPVTDFLLDMPYHIRSILHIPSAELEDSGTYTCNVTESVNDHQDEKAINITVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDTQEVIVVPHSLPFKV

SEQ ID NO: 2875 - protein, 755 aa, synthetic construct
  REGION 1..755: note = PEAR1 (Q5VY43) SP+PP+ECD
MSPPLCPLLLLAVGLRLAGTLNPSDPNTCSFWESFTTTTKESHSRPFSLLPSEPCERPWEGPHTCPQPTVVYRTVYRQVVKTDHRQRLQCCHGFYESRGFCVPLCAQECVHGRCVAPNQCQCVPGWRGDDCSSECAPGMWGPQCDKPCSCGNNSSCDPKSGVCSCPSGLQPPNCLQPCTPGYYGPACQFRCQCHGAPCDPQTGACFCPAERTGPSCDVSCSQGTSGFFCPSTHSCQNGGVFQTPQGSCSCPPGWMGTICSLPCPEGFHGPNCSQECRCHNGGLCDRFTGQCRCAPGYTGDRCREECPVGRFGQDCAETCDCAPDARCFPANGACLCEHGFTGDRCTDRLCPDGFYGLSCQAPCTCDREHSLSCHPMNGECSCLPGWAGLHCNESCPQDTHGPGCQEHCLCLHGGVCQATSGLCQCAPGYTGPHCASLCPPDTYGVNCSARCSCENAIACSPIDGECVCKEGWQRGNCSVPCPPGTWGFSCNASCQCAHEAVCSPQTGACTCTPGWHGAHCQLPCPKGQFGEGCASRCDCDHSDGCDPVHGRCQCQAGWMGARCHLSCPEGLWGVNCSNTCTCKNGGTCLPENGNCVCAPGFRGPSCQRSCQPGRYGKRCVPCKCANHSFCHPSNGTCYCLAGWTGPDCSQPCPPGHWGENCAQTCQCHHGGTCHPQDGSCICPLGWTGHHCLEGCPLGTFGANCSQPCQCGPGEKCHPETGACVCPPGHSGAPCRIGIQEPFTVMPTTPVAYNSL

SEQ ID NO: 2876 - protein, 601 aa, synthetic construct
  REGION 1..601: note = PECAM1 (P16284) SP+PP+ECD
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQVLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVTESFSTPKFHISPTGMIMEGAQLHIKCTIQVTHLAQEFPEIIIQKDKAIVAHNRHGNKAVYSVMAMVEHSGNYTCKVESSRISKVSSIVVNITELFSKPELESSFTHLDQGERLNLSCSIPGAPPANFTIQKEDTIVSQTQDFTKIASKSDSGTYICTAGIDKVVKKSNTVQIVVCEMLSQPRISYDAQFEVIKGQTIEVRCESISGTLPISYQLLKTSKVLENSTKNSNDPAVFKDNPTEDVEYQCVADNCHSHAKMLSEVLRVKVIAPVDEVQISILSSKVVESGEDIVLQCAVNEGSGPITYKFYREKEGKPFYQMTSNATQAFWTKQKASKEQEGEYYCTAFNRANHASSVPRSKILTVRVILAPWKK

SEQ ID NO: 2877 - protein, 427 aa, synthetic construct
  REGION 1..427: note = PI16 (Q6UXB8) SP+PP+ECD
MHGSCSFLMLLLPLLLLLVATTGPVGALTDEEKRLMVELHNLYRAQVSPTASDMLHMRWDEELAAFAKAYARQCVWGHNKERGRRGENLFAITDEGMDVPLAMEEWHHEREHYNLSAATCSPGQMCGHYTQVVWAKTERIGCGSHFCEKLQGVEETNIELLVCNYEPPGNVKGKRPYQEGTPCSQCPSGYHCKNSLCEPIGSPEDAQDLPYLVTEAPSFRATEASDSRKMGTPSSLATGIPAFLVTEVSGSLATKALPAVETQAPTSLATKDPPSMATEAPPCVTTEVPSILAAHSLPSLDEEPVTFPKSTHVPIPKSADKVTDKTKVPSRSPENSLDPKMSLTGARELLPHAQEEAEAEAELPPSSEVLASVFPAQDKPGELQATLDHTGHTSSKSLPNFPNTSATANATGGRALALQSSLPGAEG

SEQ ID NO: 2878 - protein, 638 aa, synthetic construct
  REGION 1..638: note = PIGR (P01833) SP+PP+ECD
MLLFVLTCLLAVFPAISTKSPIFGPEEVNSVEGNSVSITCYYPPTSVNRHTRKYWCRQGARGGCITLISSEGYVSSKYAGRANLTNFPENGTFVVNIAQLSQDDSGRYKCGLGINSRGLSFDVSLEVSQGPGLLNDTKVYTVDLGRTVTINCPFKTENAQKRKSLYKQIGLYPVLVIDSSGYVNPNYTGRIRLDIQGTGQLLFSVVINQLRLSDAGQYLCQAGDDSNSNKKNADLQVLKPEPELVYEDLRGSVTFHCALGPEVANVAKFLCRQSSGENCDVVVNTLGKRAPAFEGRILLNPQDKDGSFSVVITGLRKEDAGRYLCGAHSDGQLQEGSPIQAWQLFVNEESTIPRSPTVVKGVAGGSVAVLCPYNRKESKSIKYWCLWEGAQNGRCPLLVDSEGWVKAQYEGRLSLLEEPGNGTFTVILNQLTSRDAGFYWCLTNGDTLWRTTVEIKIIEGEPNLKVPGNVTAVLGETLKVPCHFPCKFSSYEKYWCKWNNTGCQALPSQDEGPSKAFVNCDENSRLVSLTLNLVTRADEGWYWCGVKQGHFYGETAAVYVAVEERKAAGSRDVSLAKADAAPDEKVLDSGFREIENKAIQDPRLFAEEKAVADTRDQADGSRASVDSGSSEEQGGSSR

SEQ ID NO: 2879 - protein, 527 aa, synthetic construct
  REGION 1..527: note = PIGT (Q969N2) SP+PP+ECD
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTDVDKSWKELSNVLSGIFCASLNFIDSTNTVTPTASFKPLGLANDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYN

SEQ ID NO: 2880 - protein, 168 aa, synthetic construct
  REGION 1..168: note = PIK3IP1 (Q96FE7) SP+PP+ECD
MLLAWVQAFLVSNMLLAEAYGSGGCFWDNGHLYREDQTSPAPGLRCLNWLDAQSGLASAPVSGAGNHSYCRNPDEDPRGPWCYVSGEAGVPEKRPCEDLRCPETTSQALPAFTTEIQEASEGPGADEVQVFAPANALPARSEAAAVQPVIGISQRVRMNSKEKKDLGT

SEQ ID NO: 2881 - protein, 197 aa, synthetic construct
  REGION 1..197: note = PILRA (Q9UKJ1) SP+PP+ECD
MGRPLLLPLLPLLLPPAFLQPSGSTGSGPSYLYGVTQPKHLSASMGGSVEIPFSFYYPWELATAPDVRISWRRGHFHRQSFYSTRPPSIHKDYVNRLFLNWTEGQKSGFLRISNLQKQDQSVYFCRVELDTRSSGRQQWQSIEGTKLSITQAVTTTTQRPSSMTTTWRLSSTTTTTGLRVTQGKRRSDSWHISLETA

SEQ ID NO: 2882 - protein, 191 aa, synthetic construct
  REGION 1..191: note = PILRB (Q9UKJ0) SP+PP+ECD
MGRPLLLPLLLLLQPPAFLQPGGSTGSGPSYLYGVTQPKHLSASMGGSVEIPFSFYYPWELAIVPNVRISWRRGHFHGQSFYSTRPPSIHKDYVNRLFLNWTEGQESGFLRISNLRKEDQSVYFCRVELDTRRSGRQQLQSIKGTKLTITQAVTTTTTWRPSSTTTIAGLRVTESKGHSESWHLSLDTAIR

SEQ ID NO: 2883 - protein, 3858 aa, synthetic construct
  REGION 1..3858: note = PKHD1 (P08F94) SP+PP+ECD
MTAWLISLMSIEVLLLAVRHLSLHIEPEEGSLAGGTWITVIFDGLELGVLYPNNGSQLEIHLVNVNMVVPALRSVPCDVFPVFLDLPVVTCRTRSVLSEAHEGLYFLEAYFGGQLVSSPNPGPRDSCTFKFSKAQTPIVHQVYPPSGVPGKLIHVYGWIITGRLETFDFDAEYIDSPVILEAQGDKWVTPCSLINRQMGSCYPIQEDHGLGTLQCHVEGDYIGSQNVSFSVFNKGKSMVHKKAWLISAKQDLFLYQTHSEILSVFPETGSLGGRTNITITGDFFDNSAQVTIAGIPCDIRHVSPRKIECTTRAPGKDVRLTTPQPGNRGLLFEVGDAVEGLELTEATPGYRWQIVPNASSPFGFWSQEGQPFRARLSGFFVAPETNNYTFWIQADSQASLHFSWSEEPRTKVKVASISVGTADWFDSWEQNRDEGTWQQKTPKLELLGGAMYYLEAEHHGIAPSRGMRIGVQIHNTWLNPDVVTTYLREKHQIRVRAQRLPEVQVLNVSGRGNFFLTWDNVSSQPIPANATAHLIQTTIEELLAVKCKLEPLWSNILLRLGFERGPEVSNSDGDLTSGTEPFCGRFSLRQPRHLVLTPPAAQKGYRLDQYTHLCLAYKGHMNKILKMIVSFTIGFQNMVKNTTCDWSLTRTSPESWQFDCTDLWETCVRCFGDLQPPPANSPVLVHQINLLPLAQETGLFYVDEIIIADTNVTVSQADSGTARPGGNLVESVSVVGSPPVYSVTSWLAGCGTELPLITARSVPTEGTEEGSGLVLVTTQRRQRTSPPLGGHFRIQLPNTVISDVPVQISAHHLHQLLQNNADDFTSRYLNASDFTVKEDLYTCYEHVWTLSWSTQIGDLPNFIRVSDENLTGVNPAAATRVVYDGGVFLGPIFGDMLATANQHTQVVVRVNDVPAHCPGSCSFQYLQGSTPCVHSVWYSIDGDINLMIYITGTGFSGDSQFLQVTVNKTSCKVIFSNQTNVVCQTDLLPVGMHRILMLVRPSGLAISATGEDLFLNVKPRLDMVEPSRAADIGGLWATIRGSSLEGVSLILFGSYSCAINVATSNSSRIQCKVPPRGKDGRIVNVTVIRGDYSAVLPRAFTYVSSLNPVIVTLSRNISNIAGGETLVIGVARLMNYTDLDVEVHVQDALAPVHTQSAWGLEVALPPLPAGLHRISVSINGVSIHSQGVDLHIQYLTEVFSIEPCCGSLLGGTILSISGIGFSRDPALVWVLVGNRSCDIVNLTEASIWCETLPAPQIPDAGAPTVPAAVEVWAGNRFFARGPSPSLVGKGFTFMYEAAATPVVTAMQGEITNSSLSLHVGGSNLSNSVILLGNLNCDVETQSFQGNVSLSGCSIPLHSLEAGIYPLQVRQKQMGFANMSVVLQQFAVMPRIMAIFPSQGSACGGTILTVRGLLLNSRRRSVRVDLSGPFTCVILSLGDHTILCQVSLEGDPLPGASFSLNVTVLVNGLTSECQGNCTLFIREEASPVMDALSTNTSGSLTTVLIRGQRLATTADEPMVFVDDQLPCNVTFFNASHVVCQTRDLAPGPHYLSVFYTRNGYACSGNVSRHFYIMPQVFHYFPKNFSLHGGSLLTIEGTGLRGQNTTSVYIDQQTCLTVNIGAELIRCIVPTGNGSVALEIEVDGLWYHIGVIGYNKAFTPELISISQSDDILTFAVAQISGAANIDIFIGMSPCVGVSGNHTVLQCVVPSLPAGEYHVRGYDCIRGWASSALVFTSRVIITAVTENFGCLGGRLVHVFGAGFSPGNVSAAVCGAPCRVLANATVSAFSCLVLPLDVSLAFLCGLKREEDSCEAARHTYVQCDLTVAMATEQLLESWPYLYICEESSQCLFVPDHWAESMFPSFSGLFISPKLERDEVLIYNSSCNITMETEAEMECETPNQPITVKITEIRKRWGQNTQGNFSLQFCRRWSRTHSWFPERLPQDGDNVTVENGQLLLLDTNTSILNLLHIKGGKLIFMAPGPIELRAHAILVSDGGELRIGSEDKPFQGRAQITLYGSSYSTPFFPYGVKFLAVRNGTLSLHGSLPEVIVTCLRATAHALDTVLALEDAVDWNPGDEVVIISGTGVKGAKPMEEIVTVETVQDTDLYLKSPLRYSHNFTENWVAGEHHILKATVALLSRSITIQGNLTNEREKLLVSCQEANAPEGNLQHCLYSMSEKMLGSRDMGARVIVQSFPEEPSQVQLKGVQFQVLGQAFHKHLSSLTLVGAMRESFIQGCTVRNSFSRGLSMCGTLGLKVDSNVFYNILGHALLVGTCTEMRYISWEAIHGRKDDWSGHGNIIRNNVIIQVSGAEGLSNPEMLTPSGIYICSPTNVIEGNRVCGAGYGYFFHLMTNQTSQAPLLSFTQNIAHSCTRYGLFVYPKFQPPWDNVTGTTLFQSFTVWESAGGAQIFRSSNLRLKNFKVYSCRDFGIDVLESDANTSVTDSLLLGHFAHKGSLCMSSGIKTPKRWELMVSNTTFVNFDLINCVAIRTCSDCSQGQGGFTVKTSQLKFTNSSNLVAFPFPHAAILEDLDGSLSGKNRSHILASMETLSASCLVNSSFGRVVHGSACGGGVLFHRMSIGLANTPEVSYDLTMTDSRNKTTTVNYVRDTLSNPRGWMALLLDQETYSLQSENLWINRSLQYSATFDNFAPGNYLLLVHTDLPPYPDILLRCGSRVGLSFPFLPSPGQNQGCDWFFNSQLRQLTYLVSGEGQVQVILRVKEGMPPTISASTSAPESALKWSLPETWQGVEEGWGGYNNTIPGPGDDVLILPNRTVLVDTDLPFFKGLYVMGTLDFPVDRSNVLSVACMVIAGGELKVGTLENPLEKEQKLLILLRASEGVFCDRMNGIHIDPGTIGVYGKVHLYSAYPKNSWTHLGADIASGNERIIVEDAVDWRPHDKIVLSSSSYEPHEAEVLTVKEVKGHHVRIYERLKHRHIGSVHVTEDGRHIRLAAEVGLLTRNIQIQPDVSCRGRLFVGSFRKSSREEFSGVLQLLNVEIQNFGSPLYSSVEFSNVSAGSWIISSTLHQSCGGGIHAAASHGVLLNDNIVFGTAGHGIDLEGQAYTVTNNLVVLMTQPAWSTIWVAGIKVNQVKDINLHGNVVAGSERLGFHIRGHKCSSCELLWSDNVAHSSLHGLHLYKESGLDNCTRISGFLAFKNFDYGAMLHVENSVEIENITLVDNTIGLLAVVYVFSAPQNSVKKVQIVLRNSVIVATSSSFDCIQDKVKPHSANLTSTDRAPSNPRGGRIGILWPVFTSEPNQWPQEPWHKVRNDHSISGIMKLQDVTFSSFVKSCYSDDLDVCILPNAENSGIMHPITAERTRMLKIKDKNKFYFPSLQPRKDLGKVVCPELDCASPRKYLFKDLDGRALGLPPPVSVFPKTEAEWTASFFNAGTFREEQKCTYQFLMQGFICKQTDQVVLILDSADAIWAIQKLYPVVSVTSGFVDVFSSVNANIPCSTSGSVSTFYSILPIRQITKVCFMDQTPQVLRFFLLGNKSTSKLLLAVFYHELQSPHVFLGESFIPPTLVQSASLLLNESIGANYFNIMDNLLYVVLQGEEPIEIRSGVSIHLALTVMVSVLEKGWEIVILERLTNFLQIGQNQIRFIHEMPGHEETLKAIADSRAKRKRNCPTVTCTSHYRRVGQRRPLMMEMNSHRASPPMTVETISKVIVIEIGDSPTVRSTGMISSLSSNKLQNLAHRVITAQQTGVLENVLNMTIGALLVTQSKGVIGYGNTSSFKTGNLIYIRPYALSILVQPSDGEVGNELPVQPQLVFLDEQNRRVESLGPPSEPWTISASLEGASDSVLKGCTQAETQDGYVSFYNLAVLISGSNWHFIFTVTSPPGVNFTARSKPFAVLPVTRKEKST

SEQ ID NO: 2884 - protein, 4210 aa, synthetic construct
  REGION 1..4210: note = PKHD1L1 (Q86WI1) SP+PP+ECD
MGHLWLLGIWGLCGLLLCAADPSTDGSQIIPKVTEIIPKYGSINGATRLTIRGEGFSQANQFNYGVDNAELGNSVQLISSFQSITCDVEKDASHSTQITCYTRAMPEDSYTVRVSVDGVPVTENNTCKGHINSWECTFNAKSFRTPTIRSITPLSGTPGTLITIQGRIFTDVYGSNIALSSNGKNVRILRVYIGGMPCELLIPQSDNLYGLKLDHPNGDMGSMVCKTTGTFIGHHNVSFILDNDYGRSFPQKMAYFVSSLNKIAMFQTYAEVTMIFPSQGSIRGGTTLTISGRFFDQTDFPVRVLVGGEPCDILNVTENSICCKTPPKPHILKTVYPGGRGLKLEVWNNSRPIRLEEILEYNEKTPGYMGASWVDSASYIWLMEQDTFVARFSGFLVAPDSDVYRFYIKGDDRYAIYFSQTGLPEDKVRIAYHSANANSYFSSPTQRSDDIHLQKGKEYYIEILLQEYRLSAFVDVGLYQYRNVYTEQQTGDAVNEEQVIKSQSTILQEVQVITLENWETTNAINEVQKIKVTSPCVEANSCSLYQYRLIYNMEKTVFLPADASEFILQSALNDLWSIKPDTVQVIRTQNPQSYVYMVTFISTRGDFDLLGYEVVEGNNVTLDITEQTKGKPNLETFTLNWDGIASKPLTLWSSEAEFQGAVEEMVSTKCPPQIANFEEGFVVKYFRDYETDFNLEHINRGQKTAETDAYCGRYSLKNPAVLFDSADVKPNRRPYGDILLFPYNQLCLAYKGFLANYIGLKFQYQDNSKITRSTDTQFTYNFAYGNNWTYTCIDLLDLVRTKYTGTNVSLQRISLHKASESQSFYVDVVYIGHTSTISTLDEMPKRRLPALANKGIFLEHFQVNQTKTNGPTMTNQYSVTMTSYNCSYNIPMMAVSFGQIITHETENEFVYRGNNWPGESKIHIQRIQAASPPLSGSFDIQAYGHILKGLPAAVSAADLQFALQSLEGMGRISVTREGTCAGYAWNIKWRSTCGKQNLLQINDSNIIGEKANMTVTRIKEGGLFRQHVLGDLLRTPSQQPQVEVYVNGIPAKCSGDCGFTWDSNITPLVLAISPSQGSYEEGTILTIVGSGFSPSSAVTVSVGPVGCSLLSVDEKELKCQILNGSAGHAPVAVSMADVGLAQNVGGEEFYFVYQSQISHIWPDSGSIAGGTLLTLSGFGFNENSKVLVGNETCNVIEGDLNRITCRTPKKTEGTVDISVTTNGFQATARDAFSYNCLQTPIITDFSPKVRTILGEVNLTIKGYNFGNELTQNMAVYVGGKTCQILHWNFTDIRCLLPKLSPGKHDIYVEVRNWGFASTRDKLNSSIQYVLEVTSMFPQRGSLFGGTEITIRGFGFSTIPAENTVLLGSIPCNVTSSSENVIKCILHSTGNIFRITNNGKDSVHGLGYAWSPPVLNVSVGDTVAWHWQTHPFLRGIGYRIFSVSSPGSVIYDGKGFTSGRQKSTSGSFSYQFTSPGIHYYSSGYVDEAHSIFLQGVINVLPAETRHIPLHLFVGRSEATYAYGGPENLHLGSSVAGCLATEPLCSLNNTRVKNSKRLLFEVSSCFSPSISNITPSTGTVNELITIIGHGFSNLPWANKVTIGSYPCVVEESSEDSITCHIDPQNSMDVGIRETVTLTVYNLGTAINTLSNEFDRRFVLLPNIDLVLPNAGSTTGMTSVTIKGSGFAVSSAGVKVLMGHFPCKVLSVNYTAIECETSPAAQQLVDVDLLIHGVPAQCQGNCTFSYLESITPYITGVFPNSVIGSVKVLIEGEGLGTVLEDIAVFIGNQQFRAIEVNENNITALVTPLPVGHHSVSVVVGSKGLALGNLTVSSPPVASLSPTSGSIGGGTTLVITGNGFYPGNTTVTIGDEPCQIISINPNEVYCRTPAGTTGMVDVKIFVNTIAYPPLLFTYALEDTPFLRGIIPSRGPPGTEIEITGSNFGFEILEISVMINNIQCNVTMANDSVVQCIVGDHAGGTFPVMMHHKTKGSAMSTVVFEYPLNIQNINPSQGSFGGGQTMTVTGTGFNPQNSIILVCGSECAIDRLRSDYTTLLCEIPSNNGTGAEQACEVSVVNGKDLSQSMTPFTYAVSLTPLITAVSPKRGSTAGGTRLTVVGSGFSENMEDVHITIAEAKCDVEYSNKTHIICMTDAHTLSGWAPVCVHIRGVGMAKLDNADFLYVDAWSSNFSWGGKSPPEEGSLVVITKGQTILLDQSTPILKMLLIQGGTLIFDEADIELQAENILITDGGVLQIGTETSPFQHKAVITLHGHLRSPELPVYGAKTLAVREGILDLHGVPVPVTWTRLAHTAKAGERILILQEAVTWKPGDNIVIASTGHRHSQGENEKMTIASVSADGINITLSNPLNYTHLGITVTLPDGTLFEARAEVGILTRNILIRGSDNVEWNNKIPACPDGFDTGEFATQTCLQGKFGEEIGSDQFGGCVMFHAPVPGANMVTGRIEYVEVFHAGQAFRLGRYPIHWHLLGDLQFKSYVRGCAIHQAYNRAVTIHNTHHLLVERNIIYDIKGGAFFIEDGIEHGNILQYNLAVFVQQSTSLLNDDVTPAAFWVTNPNNTIRHNAVAGGTHFGFWYRMNNHPDGPSYDRNICQKRVPLGEFFNNTVHSQGWFGMWIFEEYFPMQTGSCTSTVPAPAIFNSLTTWNCQKGAEWVNGGALQFHNFVMVNNYEAGIETKRILAPYVGGWGETNGAVIKNAKIVGHLDELGMGSAFCTAKGLVLPFSEGLTVSSVHFMNFDRPNCVALGVTSISGVCNDRCGGWSAKFVDVQYSHTPNKAGFRWEHEMVMIDVDGSLTGHKGHTVIPHSSLLDPSHCTQEAEWSIGFPGSVCDASVSFHRLAFNQPSPVSLLEKDVVLSDSFGTSIIPFQKKRLTHMSGWMALIPNANHINWYFKGVDHITNISYTSTFYGFKEEDYVIISHNFTQNPDMFNIIDMRNGSSNPLNWNTSKNGDWHLEANTSTLYYLVSGRNDLHQSQLISGNLDPDVKDVVINFQAYCCILQDCFPVHPPSRKPIPKKRPATYNLWSNDSFWQSSRENNYTVPHPGANVIIPEGTWIVADIDMPSMERLIIWGVLELEDKYNVGAAESSYREVVLNATYISLQGGRLIGGWEDNPFKGDLKIVLRGNHTTQDWALPEGPNQGAKVLGVFGELDLHGIPHSIYKTKLSETAFAGSKVLSLMDAVDWQEGEEIVITTTSYDFHQTETRSIVKILHDHKILILNDSLSYTHFAEKYHVPGTGESYTLAADVGILSRNIKIVGEDYPGWSEDSFGARVLVGSFTENMMTFKGNARISNVEFYHSGQEGFRDSTDPRYAVTFLNLGQIQEHGSSYIRGCAFHHGFSPAIGVFGTDGLDIDDNIIHFTVGEGIRIWGNANRVRGNLIALSVWPGTYQNRKDLSSTLWHAAIEINRGTNTVLQNNVVAGFGRAGYRIDGEPCPGQFNPVEKWFDNEAHGGLYGIYMNQDGLPGCSLIQGFTIWTCWDYGIYFQTTESVHIYNVTLVDNGMAIFPMIYMPAAISHKISSKNVQIKSSLIVGSSPGFNCSDVLTNDDPNIELTAAHRSPRSPSGGRSGICWPTFASAHNMAPRKPHAGIMSYNAISGLLDISGSTFVGFKNVCSGETNVIFITNPLNEDLQHPIHVKNIKLVDTTEQSKIFIHRPDISKVNPSDCVDMVCDAKRKSFLRDIDGSFLGNAGSVIPQAEYEWDGNSQVGIGDYRIPKAMLTFLNGSRIPVTEKAPHKGIIRDSTCKYLPEWQSYQCFGMEYAMMVIESLDPDTETRRLSPVAIMGNGYVDLINGPQDHGWCAGYTCQRRLSLFHSIVALNKSYEVYFTGTSPQNLRLMLLNVDHNKAVLVGIFFSTLQRLDVYVNNLLVCPKTTIWNAQQKHCELNNHLYKDQFLPNLDSTVLGENYFDGTYQMLYLLVKGTIPVEIHTATVIFVSFQLSVATEDDFYTSHNLVKNLALFLKIPSDKIRISKIRGKSLRRKRSMGFIIEIEIGDPPIQFISNGTTGQMQLSELQEIAGSLGQAVILGNISSILGFNISSMSITNPLPSPSDSGWIKVTAQPVERSAFPVHHVAFVSSLLVITQPVAAQPGQPFPQQPSVKATDSDGNCVSVGITALTLRAILKDSNNNQVNGLSGNTTIPFSSCWANYTDLTPLRTGKNYKIEFILDNVVGVESRTFSLLAESVSSSGSSSSSNSKASTVGTYAQ

SEQ ID NO: 2885 - protein, 1397 aa, synthetic construct
  REGION 1..1397: note = PLA2R1 (Q13018) SP+PP+ECD
MLLSPSLLLLLLLGAPRGCAEGVAAALTPERLLEWQDKGIFVIQSESLKKCIQAGKSVLTLENCKQANKHMLWKWVSNHGLFNIGGSGCLGLNFSAPEQPLSLYECDSTLVSLRWRCNRKMITGPLQYSVQVAHDNTVVASRKYIHKWISYGSGGGDICEYLHKDLHTIKGNTHGMPCMFPFQYNHQWHHECTREGREDDLLWCATTSRYERDEKWGFCPDPTSAEVGCDTIWEKDLNSHICYQFNLLSSLSWSEAHSSCQMQGGTLLSITDETEENFIREHMSSKTVEVWMGLNQLDEHAGWQWSDGTPLNYLNWSPEVNFEPFVEDHCGTFSSFMPSAWRSRDCESTLPYICKKYLNHIDHEIVEKDAWKYYATHCEPGWNPYNRNCYKLQKEEKTWHEALRSCQADNSALIDITSLAEVEFLVTLLGDENASETWIGLSSNKIPVSFEWSNDSSVIFTNWHTLEPHIFPNRSQLCVSAEQSEGHWKVKNCEERLFYICKKAGHVLSDAESGCQEGWERHGGFCYKIDTVLRSFDQASSGYYCPPALVTITNRFEQAFITSLISSVVKMKDSYFWIALQDQNDTGEYTWKPVGQKPEPVQYTHWNTHQPRYSGGCVAMRGRHPLGRWEVKHCRHFKAMSLCKQPVENQEKAEYEERWPFHPCYLDWESEPGLASCFKVFHSEKVLMKRTWREAEAFCEEFGAHLASFAHIEEENFVNELLHSKFNWTEERQFWIGFNKRNPLNAGSWEWSDRTPVVSSFLDNTYFGEDARNCAVYKANKTLLPLHCGSKREWICKIPRDVKPKIPFWYQYDVPWLFYQDAEYLFHTFASEWLNFEFVCSWLHSDLLTIHSAHEQEFIHSKIKALSKYGASWWIGLQEERANDEFRWRDGTPVIYQNWDTGRERTVNNQSQRCGFISSITGLWGSEECSVSMPSICKRKKVWLIEKKKDTPKQHGTCPKGWLYFNYKCLLLNIPKDPSSWKNWTHAQHFCAEEGGTLVAIESEVEQAFITMNLFGQTTSVWIGLQNDDYETWLNGKPVVYSNWSPFDIINIPSHNTTEVQKHIPLCALLSSNPNFHFTGKWYFEDCGKEGYGFVCEKMQDTSGHGVNTSDMYPMPNTLEYGNRTYKIINANMTWYAAIKTCLMHKAQLVSITDQYHQSFLTVVLNRLGYAHWIGLFTTDNGLNFDWSDGTKSSFTFWKDEESSLLGDCVFADSNGRWHSTACESFLQGAICHVPPETRQSEHPELCSETSIPWIKFKSNCYSFSTVLDSMSFEAAHEFCKKEGSNLLTIKDEAENAFLLEELFAFGSSVQMVWLNAQFDGNNETIKWFDGTPTDQSNWGIRKPDTDYFKPHHCVALRIPEGLWQLSPCQEKKGFICKMEADIHTAEALPEKGPSHS

SEQ ID NO: 2886 - protein, 1417 aa, synthetic construct
  REGION 1..1417: note = PLB1 (Q6P1J6) SP+PP+ECD
MGLRPGIFLLELLLLLGQGTPQIHTSPRKSTLEGQLWPETLKNSPFPCNPNKLGVNMPSKSVHSLKPSDIKFVAAIGNLEIPPDPGTGDLEKQDWTERPQQVCMGVMTVLSDIIRYFSPSVPMPVCHTGKRVIPHDGAEDLWIQAQELVRNMKENLQLDFQFDWKLINVFFSNASQCYLCPSAQQNGLAAGGVDELMGVLDYLQQEVPRAFVNLVDLSEVAEVSRQYHGTWLSPAPEPCNCSEETTRLAKVVMQWSYQEAWNSLLASSRYSEQESFTVVFQPFFYETTPSLHSEDPRLQDSTTLAWHLWNRMMEPAGEKDEPLSVKHGRPMKCPSQESPYLFSYRNSNYLTRLQKPQDKLEVREGAEIRCPDKDPSDTVPTSVHRLKPADINVIGALGDSLTAGNGAGSTPGNVLDVLTQYRGLSWSVGGDENIGTVTTLANILREFNPSLKGFSVGTGKETSPNAFLNQAVAGGRAEDLPVQARRLVDLMKNDTRIHFQEDWKIITLFIGGNDLCDFCNDLVHYSPQNFTDNIGKALDILHAEVPRAFVNLVTVLEIVNLRELYQEKKVYCPRMILRSLCPCVLKFDDNSTELATLIEFNKKFQEKTHQLIESGRYDTREDFTVVVQPFFENVDMPKTSEGLPDNSFFAPDCFHFSSKSHSRAASALWNNMLEPVGQKTTRHKFENKINITCPNQVQPFLRTYKNSMQGHGTWLPCRDRAPSALHPTSVHALRPADIQVVAALGDSLTAGNGIGSKPDDLPDVTTQYRGLSYSAGGDGSLENVTTLPNILREFNRNLTGYAVGTGDANDTNAFLNQAVPGAKAEDLMSQVQTLMQKMKDDHRVNFHEDWKVITVLIGGSDLCDYCTDSNLYSAANFVHHLRNALDVLHREVPRVLVNLVDFLNPTIMRQVFLGNPDKCPVQQASVLCNCVLTLRENSQELARLEAFSRAYRSSMRELVGSGRYDTQEDFSVVLQPFFQNIQLPVLADGLPDTSFFAPDCIHPNQKFHSQLARALWTNMLEPLGSKTETLDLRAEMPITCPTQNEPFLRTPRNSNYTYPIKPAIENWGSDFLCTEWKASNSVPTSVHQLRPADIKVVAALGDSLTTAVGARPNNSSDLPTSWRGLSWSIGGDGNLETHTTLPNILKKFNPYLLGFSTSTWEGTAGLNVAAEGARARDMPAQAWDLVERMKNSPDINLEKDWKLVTLFIGVNDLCHYCENPEAHLATEYVQHIQQALDILSEELPRAFVNVVEVMELASLYQGQGGKCAMLAAQNNCTCLRHSQSSLEKQELKKVNWNLQHGISSFSYWHQYTQREDFAVVVQPFFQNTLTPLNERGDTDLTFFSEDCFHFSDRGHAEMAIALWNNMLEPVGRKTTSNNFTHSRAKLKCPSPESPYLYTLRNSRLLPDQAEEAPEVLY

SEQ ID NO: 2887 - protein, 426 aa, synthetic construct
  REGION 1..426: note = PLXDC1 (Q8IUK5) SP+PP+ECD
MRGELWLLVLVLREAARALSPQPGAGHDEGPGSGWAAKGTVRGWNRRARESPGHVSEPDRTQLSQDLGGGTLAMDTLPDNRTRVVEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDNGTVFVVQWDHVYLQGWEDKGSFTFQAALHHDGRIVFAYKEIPMSVPEISSSQHPVKTGLSDAFMILNPSPDVPESRRRSIFEYHRIELDPSKVTSMSAVEFTPLPTCLQHRSCDACMSSDLTFNCSWCHVLQRCSSGFDRYRQEWMDYGCAQEAEGRMCEDFQDEDHDSASPDTSFSPYDGDLTTTSSSLFIDSLTTEDDTKLNPYAGGDGLQNNLSPKTKGTPVHLGT

SEQ ID NO: 2888 - protein, 454 aa, synthetic construct
  REGION 1..454: note = PLXDC2 (Q6UX71) SP+PP+ECD
MARFPKADLAAAGVMLLCHFFTDQFQFADGKPGDQILDWQYGVTQAFPHTEEEVEVDSHAYSHRWKRNLDFLKAVDTNRASVGQDSPEPRSFTDLLLDDGQDNNTQIEEDTDHNYYISRIYGPSDSASRDLWVNIDQMEKDKVKIHGILSNTHRQAARVNLSFDFPFYGHFLREITVATGGFIYTGEVVHRMLTATQYIAPLMANFDPSVSRNSTVRYFDNGTALVVQWDHVHLQDNYNLGSFTFQATLLMDGRIIFGYKEIPVLVTQISSTNHPVKVGLSDAFVVVHRIQQIPNVRRRTIYEYHRVELQMSKITNISAVEMTPLPTCLQFNRCGPCVSSQIGFNCSWCSKLQRCSSGFDRHRQDWVDSGCPEESKEKMCENTEPVETSSRTTTTVGATTTQFRVLTTTRRAVTSQFPTSLPTEDDTKIALHLKDNGASTDDSAAEKKGGTLHA

SEQ ID NO: 2889 - protein, 1244 aa, synthetic construct
  REGION 1..1244: note = PLXNA1 (Q9UIW2) SP+PP+ECD
MPLPPRSLQVLLLLLLLLLLLPGMWAEAGLPRAGGGSQPPFRTFSASDWGLTHLVVHEQTGEVYVGAVNRIYKLSGNLTLLRAHVTGPVEDNEKCYPPPSVQSCPHGLGSTDNVNKLLLLDYAANRLLACGSASQGICQFLRLDDLFKLGEPHHRKEHYLSSVQEAGSMAGVLIAGPPGQGQAKLFVGTPIDGKSEYFPTLSSRRLMANEEDADMFGFVYQDEFVSSQLKIPSDTLSKFPAFDIYYVYSFRSEQFVYYLTLQLDTQLTSPDAAGEHFFTSKIVRLCVDDPKFYSYVEFPIGCEQAGVEYRLVQDAYLSRPGRALAHQLGLAEDEDVLFTVFAQGQKNRVKPPKESALCLFTLRAIKEKIKERIQSCYRGEGKLSLPWLLNKELGCINSPLQIDDDFCGQDFNQPLGGTVTIEGTPLFVDKDDGLTAVAAYDYRGRTVVFAGTRSGRIRKILVDLSNPGGRPALAYESVVAQEGSPILRDLVLSPNHQYLYAMTEKQVTRVPVESCVQYTSCELCLGSRDPHCGWCVLHSICSRRDACERADEPQRFAADLLQCVQLTVQPRNVSVTMSQVPLVLQAWNVPDLSAGVNCSFEDFTESESVLEDGRIHCRSPSAREVAPITRGQGDQRVVKLYLKSKETGKKFASVDFVFYNCSVHQSCLSCVNGSFPCHWCKYRHVCTHNVADCAFLEGRVNVSEDCPQILPSTQIYVPVGVVKPITLAARNLPQPQSGQRGYECLFHIPGSPARVTALRFNSSSLQCQNSSYSYEGNDVSDLPVNLSVVWNGNFVIDNPQNIQAHLYKCPALRESCGLCLKADPRFECGWCVAERRCSLRHHCAADTPASWMHARHGSSRCTDPKILKLSPETGPRQGGTRLTITGENLGLRFEDVRLGVRVGKVLCSPVESEYISAEQIVCEIGDASSVRAHDALVEVCVRDCSPHYRALSPKRFTFVTPTFYRVSPSRGPLSGGTWIGIEGSHLNAGSDVAVSVGGRPCSFSWRNSREIRCLTPPGQSPGSAPIIININRAQLTNPEVKYNYTEDPTILRIDPEWSINSGGTLLTVTGTNLATVREPRIRAKYGGIERENGCLVYNDTTMVCRAPSVANPVRSPPELGERPDELGFVMDNVRSLLVLNSTSFLYYPDPVLEPLSPTGLLELKPSSPLILKGRNLLPPAPGNSRLNYTVLIGSTPCTLTVSETQLLCEAPNLTGQHKVTVRAGGFEFSPGTLQVYSDSLLTLP

SEQ ID NO: 2890 - protein, 1237 aa, synthetic construct
  REGION 1..1237: note = PLXNA2 (O75051) SP+PP+ECD
MEQRRPWPRALEVDSRSVVLLSVVWVLLAPPAAGMPQFSTFHSENRDWTFNHLTVHQGTGAVYVGAINRVYKLTGNLTIQVAHKTGPEEDNKSCYPPLIVQPCSEVLTLTNNVNKLLIIDYSENRLLACGSLYQGVCKLLRLDDLFILVEPSHKKEHYLSSVNKTGTMYGVIVRSEGEDGKLFIGTAVDGKQDYFPTLSSRKLPRDPESSAMLDYELHSDFVSSLIKIPSDTLALVSHFDIFYIYGFASGGFVYFLTVQPETPEGVAINSAGDLFYTSRIVRLCKDDPKFHSYVSLPFGCTRAGVEYRLLQAAYLAKPGDSLAQAFNITSQDDVLFAIFSKGQKQYHHPPDDSALCAFPIRAINLQIKERLQSCYQGEGNLELNWLLGKDVQCTKAPVPIDDNFCGLDINQPLGGSTPVEGLTLYTTSRDRMTSVASYVYNGYSVVFVGTKSGKLKKIRADGPPHGGVQYEMVSVLKDGSPILRDMAFSIDQRYLYVMSERQVTRVPVESCEQYTTCGECLSSGDPHCGWCALHNMCSRRDKCQQAWEPNRFAASISQCVSLAVHPSSISVSEHSRLLSLVVSDAPDLSAGIACAFGNLTEVEGQVSGSQVICISPGPKDVPVIPLDQDWFGLELQLRSKETGKIFVSTEFKFYNCSAHQLCLSCVNSAFRCHWCKYRNLCTHDPTTCSFQEGRINISEDCPQLVPTEEILIPVGEVKPITLKARNLPQPQSGQRGYECVLNIQGAIHRVPALRFNSSSVQCQNSSYQYDGMDISNLAVDFAVVWNGNFIIDNPQDLKVHLYKCAAQRESCGLCLKADRKFECGWCSGERRCTLHQHCTSPSSPWLDWSSHNVKCSNPQITEILTVSGPPEGGTRVTIHGVNLGLDFSEIAHHVQVAGVPCTPLPGEYIIAEQIVCEMGHALVGTTSGPVRLCIGECKPEFMTKSHQQYTFVNPSVLSLNPIRGPESGGTMVTITGHYLGAGSSVAVYLGNQTCEFYGRSMSEIVCVSPPSSNGLGPVPVSVSVDRAHVDSNLQFEYIDDPRVQRIEPEWSIASGHTPLTITGFNLDVIQEPRIRVKFNGKESVNVCKVVNTTTLTCLAPSLTTDYRPGLDTVERPDEFGFVFNNVQSLLIYNDTKFIYYPNPTFELLSPTGVLDQKPGSPIILKGKNLCPPASGGAKLNYTVLIGETPCAVTVSETQLLCEPPNLTGQHKVMVHVGGMVFSPGSVSVISDSLLTLP

SEQ ID NO: 2891 - protein, 1220 aa, synthetic construct
  REGION 1..1220: note = PLXNA3 (P51805) SP+PP+ECD
MPSVCLLLLLFLAVGGALGNRPFRAFVVTDTTLTHLAVHRVTGEVFVGAVNRVFKLAPNLTELRAHVTGPVEDNARCYPPPSMRVCAHRLAPVDNINKLLLIDYAARRLVACGSIWQGICQFLRLDDLFKLGEPHHRKEHYLSGAQEPDSMAGVIVEQGQGPSKLFVGTAVDGKSEYFPTLSSRKLISDEDSADMFSLVYQDEFVSSQIKIPSDTLSLYPAFDIYYIYGFVSASFVYFLTLQLDTQQTLLDTAGEKFFTSKIVRMCAGDSEFYSYVEFPIGCSWRGVEYRLVQSAHLAKPGLLLAQALGVPADEDVLFTIFSQGQKNRASPPRQTILCLFTLSNINAHIRRRIQSCYRGEGTLALPWLLNKELPCINTPMQINGNFCGLVLNQPLGGLHVIEGLPLLADSTDGMASVAAYTYRQHSVVFIGTRSGSLKKVRVDGFQDAHLYETVPVVDGSPILRDLLFSPDHRHIYLLSEKQVSQLPVETCEQYQSCAACLGSGDPHCGWCVLRHRCCREGACLGASAPHGFAEELSKCVQVRVRPNNVSVTSPGVQLTVTLHNVPDLSAGVSCAFEAAAENEAVLLPSGELLCPSPSLQELRALTRGHGATRTVRLQLLSKETGVRFAGADFVFYNCSVLQSCMSCVGSPYPCHWCKYRHTCTSRPHECSFQEGRVHSPEGCPEILPSGDLLIPVGVMQPLTLRAKNLPQPQSGQKNYECVVRVQGRQQRVPAVRFNSSSVQCQNASYSYEGDEHGDTELDFSVVWDGDFPIDKPPSFRALLYKCWAQRPSCGLCLKADPRFNCGWCISEHRCQLRTHCPAPKTNWMHLSQKGTRCSHPRITQIHPLVGPKEGGTRVTIVGDNLGLLSREVGLRVAGVRCNSIPAEYISAERIVCEMEESLVPSPPPGPVELCVGDCSADFRTQSEQVYSFVTPTFDQVSPSRGPASGGTRLTISGSSLDAGSRVTVTVRDSECQFVRRDAKAIVCISPLSTLGPSQAPITLAIDRANISSPGLIYTYTQDPTVTRLEPTWSIINGSTAITVSGTHLLTVQEPRVRAKYRGIETTNTCQVINDTAMLCKAPGIFLGRPQPRAQGEHPDEFGFLLDHVQTARSLNRSSFTYYPDPSFEPLGPSGVLDVKPGSHVVLKGKNLIPAAAGSSRLNYTVLIGGQPCSLTVSDTQLLCDSPSQTGRQPVMVLVGGLEFWLGTLHISAERALTLPA

SEQ ID NO: 2892 - protein, 1237 aa, synthetic construct
  REGION 1..1237: note = PLXNA4 (Q9HCM2) SP+PP+ECD
MKAMPWNWTCLLSHLLMVGMGSSTLLTRQPAPLSQKQRSFVTFRGEPAEGFNHLVVDERTGHIYLGAVNRIYKLSSDLKVLVTHETGPDEDNPKCYPPRIVQTCNEPLTTTNNVNKMLLIDYKENRLIACGSLYQGICKLLRLEDLFKLGEPYHKKEHYLSGVNESGSVFGVIVSYSNLDDKLFIATAVDGKPEYFPTISSRKLTKNSEADGMFAYVFHDEFVASMIKIPSDTFTIIPDFDIYYVYGFSSGNFVYFLTLQPEMVSPPGSTTKEQVYTSKLVRLCKEDTAFNSYVEVPIGCERSGVEYRLLQAAYLSKAGAVLGRTLGVHPDDDLLFTVFSKGQKRKMKSLDESALCIFILKQINDRIKERLQSCYRGEGTLDLAWLKVKDIPCSSALLTIDDNFCGLDMNAPLGVSDMVRGIPVFTEDRDRMTSVIAYVYKNHSLAFVGTKSGKLKKIRVDGPRGNALQYETVQVVDPGPVLRDMAFSKDHEQLYIMSERQLTRVPVESCGQYQSCGECLGSGDPHCGWCVLHNTCTRKERCERSKEPRRFASEMKQCVRLTVHPNNISVSQYNVLLVLETYNVPELSAGVNCTFEDLSEMDGLVVGNQIQCYSPAAKEVPRIITENGDHHVVQLQLKSKETGMTFASTSFVFYNCSVHNSCLSCVESPYRCHWCKYRHVCTHDPKTCSFQEGRVKLPEDCPQLLRVDKILVPVEVIKPITLKAKNLPQPQSGQRGYECILNIQGSEQRVPALRFNSSSVQCQNTSYSYEGMEINNLPVELTVVWNGHFNIDNPAQNKVHLYKCGAMRESCGLCLKADPDFACGWCQGPGQCTLRQHCPAQESQWLELSGAKSKCTNPRITEIIPVTGPREGGTKVTIRGENLGLEFRDIASHVKVAGVECSPLVDGYIPAEQIVCEMGEAKPSQHAGFVEICVAVCRPEFMARSSQLYYFMTLTLSDLKPSRGPMSGGTQVTITGTNLNAGSNVVVMFGKQPCLFHRRSPSYIVCNTTSSDEVLEMKVSVQVDRAKIHQDLVFQYVEDPTIVRIEPEWSIVSGNTPIAVWGTHLDLIQNPQIRAKHGGKEHINICEVLNATEMTCQAPALALGPDHQSDLTERPEEFGFILDNVQSLLILNKTNFTYYPNPVFEAFGPSGILELKPGTPIILKGKNLIPPVAGGNVKLNYTVLVGEKPCTVTVSDVQLLCESPNLIGRHKVMARVGGMEYSPGMVYIAPDSPLSLP

SEQ ID NO: 2893 - protein, 1490 aa, synthetic construct
  REGION 1..1490: note = PLXNB1 (O43157) SP+PP+ECD
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQSPLVSPDPPARGGPSPSPPTAPKALATPAPDTLPVEPGAPSTATASDISPGASPSLLSPWGPWAGSGSISSPGSTGSPLHEEPSPPSPQNGPGTAVPAPTDFRPSATPEDLLASPLSPSEVAAVPPADPGPEALHPTVPLDLPPATVPATTFPGAMGSVKPALDWLTREGGELPEADEWTGGDAPAFSTSTLLSGDGDSAELEGPPAPLILPSSLDYQYDTPGLWELEEATLGASSCPCVESVQGSTLMPVHVEREIRLLGRNLHLFQDGPGDNECVMELEGLEVVVEARVECEPPPDTQCHVTCQQHQLSYEALQPELRVGLFLRRAGRLRVDSAEGLHVVLYDCSVGHGDCSRCQTAMPQYGCVWCEGERPRCVTREACGEAEAVATQCPAPLIHSVEPLTGPVDGGTRVTIRGSNLGQHVQDVLGMVTVAGVPCAVDAQEYEVSSSLVCITGASGEEVAGATAVEVPGRGRGVSEHDFAYQDPKVHSIFPARGPRAGGTRLTLNGSKLLTGRLEDIRVVVGDQPCHLLPEQQSEQLRCETSPRPTPATLPVAVWFGATERRLQRGQFKYTLDPNITSAGPTKSFLSGGREICVRGQNLDVVQTPRIRVTVVSRMLQPSQGLGRRRRVVPETACSLGPSCSSQQFEEPCHVNSSQLITCRTPALPGLPEDPWVRVEFILDNLVFDFATLNPTPFSYEADPTLQPLNPEDPTMPFRHKPGSVFSVEGENLDLAMSKEEVVAMIGDGPCVVKTLTRHHLYCEPPVEQPLPRHHALREAPDSLPEFTVQMGNLRFSLGHVQYDGESPGAFPVAAQ

SEQ ID NO: 2894 - protein, 1197 aa, synthetic construct
  REGION 1..1197: note = PLXNB2 (O15031) SP+PP+ECD
MALQLWALTLLGLLGAGASLRPRKLDFFRSEKELNHLAVDEASGVVYLGAVNALYQLDAKLQLEQQVATGPALDNKKCTPPIEASQCHEAEMTDNVNQLLLLDPPRKRLVECGSLFKGICALRALSNISLRLFYEDGSGEKSFVASNDEGVATVGLVSSTGPGGDRVLFVGKGNGPHDNGIIVSTRLLDRTDSREAFEAYTDHATYKAGYLSTNTQQFVAAFEDGPYVFFVFNQQDKHPARNRTLLARMCREDPNYYSYLEMDLQCRDPDIHAAAFGTCLAASVAAPGSGRVLYAVFSRDSRSSGGPGAGLCLFPLDKVHAKMEANRNACYTGTREARDIFYKPFHGDIQCGGHAPGSSKSFPCGSEHLPYPLGSRDGLRGTAVLQRGGLNLTAVTVAAENNHTVAFLGTSDGRILKVYLTPDGTSSEYDSILVEINKRVKRDLVLSGDLGSLYAMTQDKVFRLPVQECLSYPTCTQCRDSQDPYCGWCVVEGRCTRKAECPRAEEASHWLWSRSKSCVAVTSAQPQNMSRRAQGEVQLTVSPLPALSEEDELLCLFGESPPHPARVEGEAVICNSPSSIPVTPPGQDHVAVTIQLLLRRGNIFLTSYQYPFYDCRQAMSLEENLPCISCVSNRWTCQWDLRYHECREASPNPEDGIVRAHMEDSCPQFLGPSPLVIPMNHETDVNFQGKNLDTVKGSSLHVGSDLLKFMEPVTMQESGTFAFRTPKLSHDANETLPLHLYVKSYGKNIDSKLHVTLYNCSFGRSDCSLCRAANPDYRCAWCGGQSRCVYEALCNTTSECPPPVITRIQPETGPLGGGIRITILGSNLGVQAGDIQRISVAGRNCSFQPERYSVSTRIVCVIEAAETPFTGGVEVDVFGKLGRSPPNVQFTFQQPKPLSVEPQQGPQAGGTTLTIHGTHLDTGSQEDVRVTLNGVPCKVTKFGAQLQCVTGPQATRGQMLLEVSYGGSPVPNPGIFFTYRENPVLRAFEPLRSFASGGRSINVTGQGFSLIQRFAMVVIAEPLQSWQPPREAESLQPMTVVGTDYVFHNDTKVVFLSPAVPEEPEAYNLTVLIEMDGHRALLRTEAGAFEYVPDPTFENFTGGVKKQVNKLIHARGTNLNKAMTLQEAEAFVGAERCTMKTLTETDLYCEPPEVQPPPKRRQKRDTTHNLPEFIVKFGSREWVLGRVEYDTRVSDVP

SEQ ID NO: 2895 - protein, 1255 aa, synthetic construct
  REGION 1..1255: note = PLXNB3 (Q9ULL4) SP+PP+ECD
MCHAAQETPLLHHFMAPVMARWPPFGLCLLLLLLSPPPLPLTGAHRFSAPNTTLNHLALAPGRGTLYVGAVNRLFQLSPELQLEAVAVTGPVIDSPDCVPFRDPAECPQAQLTDNANQLLLVSSRAQELVACGQVRQGVCETRRLGDVAEVLYQAEDPGDGQFVAANTPGVATVGLVVPLPGRDLLLVARGLAGKLSAGVPPLAIRQLAGSQPFSSEGLGRLVVGDFSDYNNSYVGAFADARSAYFVFRRRGARAQAEYRSYVARVCLGDTNLYSYVEVPLACQGQGLIQAAFLAPGTLLGVFAAGPRGTQAALCAFPMVELGASMEQARRLCYTAGGRGPSGAEEATVEYGVTSRCVTLPLDSPESYPCGDEHTPSPIAGRQPLEVQPLLKLGQPVSAVAALQADGHMIAFLGDTQGQLYKVFLHGSQGQVYHSQQVGPPGSAISPDLLLDSSGSHLYVLTAHQVDRIPVAACPQFPDCASCLQAQDPLCGWCVLQGRCTRKGQCGRAGQLNQWLWSYEEDSHCLHIQSLLPGHHPRQEQGQVTLSVPRLPILDADEYFHCAFGDYDSLAHVEGPHVACVTPPQDQVPLNPPGTDHVTVPLALMFEDVTVAATNFSFYDCSAVQALEAAAPCRACVGSIWRCHWCPQSSHCVYGEHCPEGERTIYSAQEVDIQVRGPGACPQVEGLAGPHLVPVGWESHLALRVRNLQHFRGLPASFHCWLELPGELRGLPATLEETAGDSGLIHCQAHQFYPSMSQRELPVPIYVTQGEAQRLDNTHALYVILYDCAMGHPDCSHCQAANRSLGCLWCADGQPACRYGPLCPPGAVELLCPAPSIDAVEPLTGPPEGGLALTILGSNLGRAFADVQYAVSVASRPCNPEPSLYRTSARIVCVTSPAPNGTTGPVRVAIKSQPPGISSQHFTYQDPVLLSLSPRWGPQAGGTQLTIRGQHLQTGGNTSAFVGGQPCPILEPVCPEAIVCRTRPQAAPGEAAVLVVFGHAQRTLLASPFRYTANPQLVAAEPSASFRGGGRLIRVRGTGLDVVQRPLLSVWLEADAEVQASRAQPQDPQPRRSCGAPAADPQACIQLGGGLLQCSTVCSVNSSSLLLCRSPAVPDRAHPQRVFFTLDNVQVDFASASGGQGFLYQPNPRLAPLSREGPARPYRLKPGHVLDVEGEGLNLGISKEEVRVHIGRGECLVKTLTRTHLYCEPPAHAPQPANGSGLPQFVVQMGNVQLALGPVQYEAEPPLSAFPVEAQ

SEQ ID NO: 2896 - protein, 944 aa, synthetic construct
  REGION 1..944: note = PLXNC1 (O60486) SP+PP+ECD
MEVSRRKAPPRPPRPAAPLPLLAYLLALAAPGRGADEPVWRSEQAIGAIAASQEDGVFVASGSCLDQLDYSLEHSLSRLYRDQAGNCTEPVSLAPPARPRPGSSFSKLLLPYREGAAGLGGLLLTGWTFDRGACEVRPLGNLSRNSLRNGTEVVSCHPQGSTAGVVYRAGRNNRWYLAVAATYVLPEPETASRCNPAASDHDTAIALKDTEGRSLATQELGRLKLCEGAGSLHFVDAFLWNGSIYFPYYPYNYTSGAATGWPSMARIAQSTEVLFQGQASLDCGHGHPDGRRLLLSSSLVEALDVWAGVFSAAAGEGQERRSPTTTALCLFRMSEIQARAKRVSWDFKTAESHCKEGDQPERVQPIASSTLIHSDLTSVYGTVVMNRTVLFLGTGDGQLLKVILGENLTSNCPEVIYEIKEETPVFYKLVPDPVKNIYIYLTAGKEVRRIRVANCNKHKSCSECLTATDPHCGWCHSLQRCTFQGDCVHSENLENWLDISSGAKKCPKIQIIRSSKEKTTVTMVGSFSPRHSKCMVKNVDSSRELCQNKSQPNRTCTCSIPTRATYKDVSVVNVMFSFGSWNLSDRFNFTNCSSLKECPACVETGCAWCKSARRCIHPFTACDPSDYERNQEQCPVAVEKTSGGGRPKENKGNRTNQALQVFYIKSIEPQKVSTLGKSNVIVTGANFTRASNITMILKGTSTCDKDVIQVSHVLNDTHMKFSLPSSRKEMKDVCIQFDGGNCSSVGSLSYIALPHCSLIFPATTWISGGQNITMMGRNFDVIDNLIISHELKGNINVSEYCVATYCGFLAPSLKSSKVRTNVTVKLRVQDTYLDCGTLQYREDPRFTGYRVESEVDTELEVKIQKENDNFNISKKDIEITLFHGENGQLNCSFENITRNQDLTTILCKIKGIKTASTIANSSKKVRVKLGNLELYVEQESVPST

SEQ ID NO: 2897 - protein, 1271 aa, synthetic construct
  REGION 1..1271: note = PLXND1 (Q9Y4D7) SP+PP+ECD
MAPRAAGGAPLSARAAAASPPPFQTPPRCPVPLLLLLLLGAARAGALEIQRRFPSPTPTNNFALDGAAGTVYLAAVNRLYQLSGANLSLEAEAAVGPVPDSPLCHAPQLPQASCEHPRRLTDNYNKILQLDPGQGLVVVCGSIYQGFCQLRRRGNISAVAVRFPPAAPPAEPVTVFPSMLNVAANHPNASTVGLVLPPAAGAGGSRLLVGATYTGYGSSFFPRNRSLEDHRFENTPEIAIRSLDTRGDLAKLFTFDLNPSDDNILKIKQGAKEQHKLGFVSAFLHPSDPPPGAQSYAYLALNSEARAGDKESQARSLLARICLPHGAGGDAKKLTESYIQLGLQCAGGAGRGDLYSRLVSVFPARERLFAVFERPQGSPAARAAPAALCAFRFADVRAAIRAARTACFVEPAPDVVAVLDSVVQGTGPACERKLNIQLQPEQLDCGAAHLQHPLSILQPLKATPVFRAPGLTSVAVASVNNYTAVFLGTVNGRLLKINLNESMQVVSRRVVTVAYGEPVHHVMQFDPADSGYLYLMTSHQMARVKVAACNVHSTCGDCVGAADAYCGWCALETRCTLQQDCTNSSQQHFWTSASEGPSRCPAMTVLPSEIDVRQEYPGMILQISGSLPSLSGMEMACDYGNNIRTVARVPGPAFGHQIAYCNLLPRDQFPPFPPNQDHVTVEMSVRVNGRNIVKANFTIYDCSRTAQVYPHTACTSCLSAQWPCFWCSQQHSCVSNQSRCEASPNPTSPQDCPRTLLSPLAPVPTGGSQNILVPLANTAFFQGAALECSFGLEEIFEAVWVNESVVRCDQVVLHTTRKSQVFPLSLQLKGRPARFLDSPEPMTVMVYNCAMGSPDCSQCLGREDLGHLCMWSDGCRLRGPLQPMAGTCPAPEIHAIEPLSGPLDGGTLLTIRGRNLGRRLSDVAHGVWIGGVACEPLPDRYTVSEEIVCVTGPAPGPLSGVVTVNASKEGKSRDRFSYVLPLVHSLEPTMGPKAGGTRITIHGNDLHVGSELQVLVNDTDPCTELMRTDTSIACTMPEGALPAPVPVCVRFERRGCVHGNLTFWYMQNPVITAISPRRSPVSGGRTITVAGERFHMVQNVSMAVHHIGREPTLCKVLNSTLITCPSPGALSNASAPVDFFINGRAYADEVAVAEELLDPEEAQRGSRFRLDYLPNPQFSTAKREKWIKHHPGEPLTLVIHKEQDSLGLQSHEYRVKIGQVSCDIQIVSDRIIHCSVNESLGAAVGQLPITIQVGNFNQTIATLQLGGSETA

SEQ ID NO: 2898 - protein, 467 aa, synthetic construct
  REGION 1..467: note = PMEL (P40967) SP+PP+ECD
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLV

SEQ ID NO: 2899 - protein, 461 aa, synthetic construct
  REGION 1..461: note = PODXL (O00592) SP+PP+ECD
MRCALALSALLLLLSTPPLLPSSPSPSPSPSQNATQTTTDSSNKTAPTPASSVTIMATDTAQQSTVPTSKANEILASVKATTLGVSSDSPGTTTLAQQVSGPVNTTVARGGGSGNPTTTIESPKSTKSADTTTVATSTATAKPNTTSSQNGAEDTTNSGGKSSHSVTTDLTSTKAEHLTTPHPTSPLSPRQPTSTHPVATPTSSGHDHLMKISSSSSTVAIPGYTFTSPGMTTTLLETVFHHVSQAGLELLTSGDLPTLASQSAGITASSVISQRTQQTSSQMPASSTAPSSQETVQPTSPATALRTPTLPETMSSSPTAASTTHRYPKTPSPTVAHESNWAKCEDLETQTQSEKQLVLNLTGNTLCAGGASDEKLISLICRAVKATFNPAQDKCGIRLASVPGSQTVVVKEITIHTKLPAKDVYERLKDKWDELKEAGVSDMKLGDQGPPEEAEDRFSMP

SEQ ID NO: 2900 - protein, 500 aa, synthetic construct
  REGION 1..500: note = PODXL2 (Q9NZ53) SP+PP+ECD
MGRLLRAARLPPLLSPLLLLLVGGAFLGACVAGSDEPGPEGLTSTSLLDLLLPTGLEPLDSEEPSETMGLGAGLGAPGSGFPSEENEESRILQPPQYFWEEEEELNDSSLDLGPTADYVFPDLTEKAGSIEDTSQAQELPNLPSPLPKMNLVEPPWHMPPREEEEEEEEEEEREKEEVEKQEEEEEEELLPVNGSQEEAKPQVRDFSLTSSSQTPGATKSRHEDSGDQASSGVEVESSMGPSLLLPSVTPTTVTPGDQDSTSQEAEATVLPAAGLGVEFEAPQEASEEATAGAAGLSGQHEEVPALPSFPQTTAPSGAEHPDEDPLGSRTSASSPLAPGDMELTPSSATLGQEDLNQQLLEGQAAEAQSRIPWDSTQVICKDWSNLAGKNYIILNMTENIDCEVFRQHRGPQLLALVEEVLPRHGSGHHGAWHISLSKPSEKEQHLLMTLVGEQGVVPTQDVLSMLGDIRRSLEEIGIQNYSTTSSCQARASQVRSDYGT

SEQ ID NO: 2901 - protein, 92 aa, synthetic construct
  REGION 1..92: note = PRIMA1 (Q86XR5) SP+PP+ECD
MLLRDLVLRRGCCWSSLLLHCALHPLWGFVQVTHGEPQKSCSKVTDSCRHVCQCRPPPPLPPPPPPPPPPRLLSAPAPNSTSCPTEESWWSG

SEQ ID NO: 2902 - protein, 234 aa, synthetic construct
  REGION 1..234: note = PRLR (P16471) SP+PP+ECD
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMND

SEQ ID NO: 2903 - protein, 210 aa, synthetic construct
  REGION 1..210: note = PROCR (Q9UNN8) SP+PP+ECD
MLTTLLPILLLSGWAFCSQDASDGLQRLHMLQISYFRDPYHVWYQGNASLGGHLTHVLEGPDTNTTIIQLQPLQEPESWARTQSGLQSYLLQFHGLVRLVHQERTLAFPLTIRCFLGCELPPEGSRAHVFFEVAVNGSSFVSFRPERALWQADTQVTSGVVTFTLQQLNAYNRTRYELREFLEDTCVQYVQKHISAENTKGSQTSRSYTS

SEQ ID NO: 2904 - protein, 319 aa, synthetic construct
  REGION 1..319: note = PRSS8 (Q16651) SP+PP+ECD
MAQKGVLGPGQLGAVAILLYLGLLRSGTGAEGAEAPCGVAPQARITGGSSAVAGQWPWQVSITYEGVHVCGGSLVSEQWVLSAAHCFPSEHHKEAYEVKLGAHQLDSYSEDAKVSTLKDIIPHPSYLQEGSQGDIALLQLSRPITFSRYIRPICLPAANASFPNGLHCTVTGWGHVAPSVSLLTPKPLQQLEVPLISRETCNCLYNIDAKPEEPHFVQEDMVCAGYVEGGKDACQGDSGGPLSCPVEGLWYLTGIVSWGDACGARNRPGVYTLASSYASWIQSKVTELQPRVVPQTQESQPDSNLCGSHLAFSSAPAQG

SEQ ID NO: 2905 - protein, 949 aa, synthetic construct
  REGION 1..949: note = PRTG (Q2VWP7) SP+PP+ECD
MAPPLRPLARLRPPGMLLRALLLLLLLSPLPGVWCFSELSFVKEPQDVTVTRKDPVVLDCQAHGEVPIKVTWLKNGAKMSENKRIEVLSNGSLYISEVEGRRGEQSDEGFYQCLAMNKYGAILSQKAHLALSTISAFEVQPISTEVHEGGVARFACKISSHPPAVITWEFNRTTLPMTMDRITALPTGVLQIYDVSQRDSGNYRCIAATVAHRRKSMEASLTVIPAKESKSFHTPTIIAGPQNITTSLHQTVVLECMATGNPKPIISWSRLDHKSIDVFNTRVLGNGNLMISDVRLQHAGVYVCRATTPGTRNFTVAMATLTVLAPPSFVEWPESLTRPRAGTARFVCQAEGIPSPKMSWLKNGRKIHSNGRIKMYNSKLVINQIIPEDDAIYQCMAENSQGSILSRARLTVVMSEDRPSAPYNVHAETMSSSAILLAWERPLYNSDKVIAYSVHYMKAEGLNNEEYQVVIGNDTTHYIIDDLEPASNYTFYIVAYMPMGASQMSDHVTQNTLEDVPLRPPEISLTSRSPTDILISWLPIPAKYRRGQVVLYRLSFRLSTENSIQVLELPGTTHEYLLEGLKPDSVYLVRITAATRVGLGESSVWTSHRTPKATSVKAPKSPELHLEPLNCTTISVRWQQDVEDTAAIQGYKLYYKEEGQQENGPIFLDTKDLLYTLSGLDPRRKYHVRLLAYNNIDDGYQADQTVSTPGCVSVRDRMVPPPPPPHHLYAKANTSSSIFLHWRRPAFTAAQIINYTIRCNPVGLQNASLVLYLQTSETHMLVQGLEPNTKYEFAVRLHVDQLSSPWSPVVYHSTLPEAPAGPPVGVKVTLIEDDTALVSWKPPDGPETVVTRYTILYASRKAWIAGEWQVLHREGAITMALLENLVAGNVYIVKISASNEVGEGPFSNSVELAVLPKETSESNQRPKRLDSADAKVYSGYYHLDQKSMT

SEQ ID NO: 2906 - protein, 146 aa, synthetic construct
  REGION 1..146: note = PTCRA (Q6ISU1) SP+PP+ECD
MAGTWLLLLLALGCPALPTGVGGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGG

SEQ ID NO: 2907 - protein, 832 aa, synthetic construct
  REGION 1..832: note = PTGFRN (Q9P2B2) SP+PP+ECD
MGRLASRPLLLALLSLALCRGRVVRVPTATLVRVVGTELVIPCNVSDYDGPSEQNFDWSFSSLGSSFVELASTWEVGFPAQLYQERLQRGEILLRRTANDAVELHIKNVQPSDQGHYKCSTPSTDATVQGNYEDTVQVKVLADSLHVGPSARPPPSLSLREGEPFELRCTAASASPLHTHLALLWEVHRGPARRSVLALTHEGRFHPGLGYEQRYHSGDVRLDTVGSDAYRLSVSRALSADQGSYRCIVSEWIAEQGNWQEIQEKAVEVATVVIQPSVLRAAVPKNVSVAEGKELDLTCNITTDRADDVRPEVTWSFSRMPDSTLPGSRVLARLDRDSLVHSSPHVALSHVDARSYHLLVRDVSKENSGYYYCHVSLWAPGHNRSWHKVAEAVSSPAGVGVTWLEPDYQVYLNASKVPGFADDPTELACRVVDTKSGEANVRFTVSWYYRMNRRSDNVVTSELLAVMDGDWTLKYGERSKQRAQDGDFIFSKEHTDTFNFRIQRTTEEDRGNYYCVVSAWTKQRNNSWVKSKDVFSKPVNIFWALEDSVLVVKARQPKPFFAAGNTFEMTCKVSSKNIKSPRYSVLIMAEKPVGDLSSPNETKYIISLDQDSVVKLENWTDASRVDGVVLEKVQEDEFRYRMYQTQVSDAGLYRCMVTAWSPVRGSLWREAATSLSNPIEIDFQTSGPIFNASVHSDTPSVIRGDLIKLFCIITVEGAALDPDDMAFDVSWFAVHSFGLDKAPVLLSSLDRKGIVTTSRRDWKSDLSLERVSVLEFLLQVHGSEDQDFGNYYCSVTPWVKSPTGSWQKEAEIHSKPVFITVKMDVLNAFKYP

SEQ ID NO: 2908 - protein, 704 aa, synthetic construct
  REGION 1..704: note = PTK7 (Q13308) SP+PP+ECD
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQT

SEQ ID NO: 2909 - protein, 151 aa, synthetic construct
  REGION 1..151: note = PTPRA (P18433) SP+PP+ECD
MDSWFILVLLGSGLICVSANNATTVAPSVGITRLINSSTAEPVKEEAKTSNPTSSLTSLSVAPTFSPNITLGPTYLTTVNSSDSDNGTTRTASTNSIGITISPNGTWLPDNQFTDARTEPWEGNSSTAATTPETFPPSGNSDSKDRRDETP

SEQ ID NO: 2910 - protein, 1621 aa, synthetic construct
  REGION 1..1621: note = PTPRB (P23467) SP+PP+ECD
MLSHGAGLALWITLSLLQTGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKCDPTQQKFCDGPLKPHTAYRISIRAFTQLFDEDLKEFTKPLYSDTFFSLPITTESEPLFGAIE

SEQ ID NO: 2911 - protein, 577 aa, synthetic construct
  REGION 1..577: note = PTPRC (P08575) SP+PP+ECD
MTMYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSK

SEQ ID NO: 2912 - protein, 1265 aa, synthetic construct
  REGION 1..1265: note = PTPRD (P23468) SP+PP+ECD
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSESIGGTPIRGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSKPSAPPQDISCTSPSSTSILVSWQPPPVEKQNGIITEYSIKYTAVDGEDDKPHEILGIPSDTTKYLLEQLEKWTEYRITVTAHTDVGPGPESLSVLIRTNEDVPSGPPRKVEVEAVNSTSVKVSWRSPVPNKQHGQIRGYQVHYVRMENGEPKGQPMLKDVMLADAQWEFDDTTEHDMIISGLQPETSYSLTVTAYTTKGDGARSKPKLVSTTGAVPGKPRLVINHTQMNTALIQWHPPVDTFGPLQGYRLKFGRKDMEPLTTLEFSEKEDHFTATDIHKGASYVFRLSARNKVGFGEEMVKEISIPEEVPTGFPQNLHSEGTTSTSVQLSWQPPVLAERNGIITKYTLLYRDINIPLLPMEQLIVPADTTMTLTGLKPDTTYDVKVRAHTSKGPGPYSPSVQFRTLPVDQVFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEE

SEQ ID NO: 2913 - protein, 1263 aa, synthetic construct
  REGION 1..1263: note = PTPRF (P10586) SP+PP+ECD
MAPEPAPGRTMVPLVPALVMLGLVAGAHGDSKPVFIKVPEDQTGLSGGVASFVCQATGEPKPRITWMKKGKKVSSQRFEVIEFDDGAGSVLRIQPLRVQRDEAIYECTATNSLGEINTSAKLSVLEEEQLPPGFPSIDMGPQLKVVEKARTATMLCAAGGNPDPEISWFKDFLPVDPATSNGRIKQLRSGALQIESSEESDQGKYECVATNSAGTRYSAPANLYVRVRRVAPRFSIPPSSQEVMPGGSVNLTCVAVGAPMPYVKWMMGAEELTKEDEMPVGRNVLELSNVVRSANYTCVAISSLGMIEATAQVTVKALPKPPIDLVVTETTATSVTLTWDSGNSEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSTPSAPPQKVMCVSMGSTTVRVSWVPPPADSRNGVITQYSVAYEAVDGEDRGRHVVDGISREHSSWDLVGLEKWTEYRVWVRAHTDVGPGPESSPVLVRTDEDVPSGPPRKVEVEPLNSTAVHVYWKLPVPSKQHGQIRGYQVTYVRLENGEPRGLPIIQDVMLAEAQWRPEESEDYETTISGLTPETTYSVTVAAYTTKGDGARSKPKIVTTTGAVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLW

SEQ ID NO: 2914 - protein, 736 aa, synthetic construct
  REGION 1..736: note = PTPRG (P23470) SP+PP+ECD
MRRLLEPCWWILFLKITSSVLHYVVCFPALTEGYVGALHENRHGSAVQIRRRKASGDPYWAYSGAYGPEHWVTSSVSCGGRHQSPIDILDQYARVGEEYQELQLDGFDNESSNKTWMKNTGKTVAILLKDDYFVSGAGLPGRFKAEKVEFHWGHSNGSAGSEHSINGRRFPVEMQIFFYNPDDFDSFQTAISENRIIGAMAIFFQVSPRDNSALDPIIHGLKGVVHHEKETFLDPFVLRDLLPASLGSYYRYTGSLTTPPCSEIVEWIVFRRPVPISYHQLEAFYSIFTTEQQDHVKSVEYLRNNFRPQQRLHDRVVSKSAVRDSWNHDMTDFLENPLGTEASKVCSSPPIHMKVQPLNQTALQVSWSQPETIYHPPIMNYMISYSWTKNEDEKEKTFTKDSDKDLKATISHVSPDSLYLFRVQAVCRNDMRSDFSQTMLFQANTTRIFQGTRIVKTGVPTASPASSADMAPISSGSSTWTSSGIPFSFVSMATGMGPSSSGSQATVASVVTSTLLAGLGFGGGGISSFPSTVWPTRLPTAASASKQAARPVLATTEALASPGPDGDSSPTKDGEGTEEGEKDEKSESEDGEREHEEDGEKDSEKKEKSGVTHAAEERNQTEPSPTPSSPNRTAEGGHQTIPGHEQDHTAVPTDQTGGRRDAGPGLDPDMVTSTQVPPTATEEQYAGSDPKRPEMPSKKPMSRGDRFSEDSRFITVNPAEKNTSGMISRPAPGRME

SEQ ID NO: 2915 - protein, 754 aa, synthetic construct
  REGION 1..754: note = PTPRH (Q9HD43) SP+PP+ECD
MAGAGGGLGVWGNLVLLGLCSWTGARAPAPNPGRNLTVETQTTSSISLSWEVPDGLDSQNSNYWVQCTGDGGTTETRNTTATNVTVDGLGPGSLYTCSVWVEKDGVNSSVGTVTTATAPNPVRNLRVEAQTNSSIALTWEVPDGPDPQNSTYGVEYTGDGGRAGTRSTAHTNITVDGLEPGCLYAFSMWVGKNGINSSRETRNATTAHNPVRNLRVEAQTTSSISLSWEVPDGTDPQNSTYCVQCTGDGGRTETRNTTDTRVTVDGLGPGSLYTCSVWVEKDGVNSSVEIVTSATAPNPVRNLTVEAQTNSSIALTWEVPDGPDPQNSTYGVEYTGDGGRAGTRSTAHTNITVDRLEPGCLYVFSVWVGKNGINSSRETRNATTAPNPVRNLHMETQTNSSIALCWEVPDGPYPQDYTYWVEYTGDGGGTETRNTTNTSVTAERLEPGTLYTFSVWAEKNGARGSRQNVSISTVPNAVTSLSKQDWTNSTIALRWTAPQGPGQSSYSYWVSWVREGMTDPRTQSTSGTDITLKELEAGSLYHLTVWAERNEVRGYNSTLTAATAPNEVTDLQNETQTKNSVMLWWKAPGDPHSQLYVYWVQWASKGHPRRGQDPQANWVNQTSRTNETWYKVEALEPGTLYNFTVWAERNDVASSTQSLCASTYPDTVTITSCVSTSAGYGVNLIWSCPQGGYEAFELEVGGQRGSQDRSSCGEAVSVLGLGPARSYPATITTIWDGMKVVSHSVVCHTESAGV

SEQ ID NO: 2916 - protein, 975 aa, synthetic construct
  REGION 1..975: note = PTPRJ (Q12913) SP+PP+ECD
MKPAAREARLPPRSPGLRWALPLLLLLLRLGQILCAGGTPSPIPDPSVATVATGENGITQISSTAESFHKQNGTGTPQVETNTSEDGESSGANDSLRTPEQGSNGTDGASQKTPSSTGPSPVFDIKAVSISPTNVILTWKSNDTAASEYKYVVKHKMENEKTITVVHQPWCNITGLRPATSYVFSITPGIGNETWGDPRVIKVITEPIPVSDLRVALTGVRKAALSWSNGNGTASCRVLLESIGSHEELTQDSRLQVNISGLKPGVQYNINPYLLQSNKTKGDPLGTEGGLDASNTERSRAGSPTAPVHDESLVGPVDPSSGQQSRDTEVLLVGLEPGTRYNATVYSQAANGTEGQPQAIEFRTNAIQVFDVTAVNISATSLTLIWKVSDNESSSNYTYKIHVAGETDSSNLNVSEPRAVIPGLRSSTFYNITVCPVLGDIEGTPGFLQVHTPPVPVSDFRVTVVSTTEIGLAWSSHDAESFQMHITQEGAGNSRVEITTNQSIIIGGLFPGTKYCFEIVPKGPNGTEGASRTVCNRTVPSAVFDIHVVYVTTTEMWLDWKSPDGASEYVYHLVIESKHGSNHTSTYDKAITLQGLIPGTLYNITISPEVDHVWGDPNSTAQYTRPSNVSNIDVSTNTTAATLSWQNFDDASPTYSYCLLIEKAGNSSNATQVVTDIGITDATVTELIPGSSYTVEIFAQVGDGIKSLEPGRKSFCTDPASMASFDCEVVPKEPALVLKWTCPPGANAGFELEVSSGAWNNATHLESCSSENGTEYRTEVTYLNFSTSYNISITTVSCGKMAAPTRNTCTTGITDPPPPDGSPNITSVSHNSVKVKFSGFEASHGPIKAYAVILTTGEAGHPSADVLKYTYEDFKKGASDTYVTYLIRTEEKGRSQSLSEVLKYEIDVGNESTTLGYYNGKLEPLGSYRACVAGFTNITFHPQNKGLIDGAESYVSFSRYSDAVSLPQDPGVICG

SEQ ID NO: 2917 - protein, 752 aa, synthetic construct
  REGION 1..752: note = PTPRK (Q15262) SP+PP+ECD
MDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAATEEPEVIPDPAKQTDRVVK

SEQ ID NO: 2918 - protein, 742 aa, synthetic construct
  REGION 1..742: note = PTPRM (P28827) SP+PP+ECD
MRGLGTCLATLAGLLLTAAGETFSGGCLFDEPYSTCGYSQSEGDDFNWEQVNTLTKPTSDPWMPSGSFMLVNASGRPEGQRAHLLLPQLKENDTHCIDFHYFVSSKSNSPPGLLNVYVKVNNGPLGNPIWNISGDPTRTWNRAELAISTFWPNFYQVIFEVITSGHQGYLAIDEVKVLGHPCTRTPHFLRIQNVEVNAGQFATFQCSAIGRTVAGDRLWLQGIDVRDAPLKEIKVTSSRRFIASFNVVNTTKRDAGKYRCMIRTEGGVGISNYAELVVKEPPVPIAPPQLASVGATYLWIQLNANSINGDGPIVAREVEYCTASGSWNDRQPVDSTSYKIGHLDPDTEYEISVLLTRPGEGGTGSPGPALRTRTKCADPMRGPRKLEVVEVKSRQITIRWEPFGYNVTRCHSYNLTVHYCYQVGGQEQVREEVSWDTENSHPQHTITNLSPYTNVSVKLILMNPEGRKESQELIVQTDEDLPGAVPTESIQGSTFEEKIFLQWREPTQTYGVITLYEITYKAVSSFDPEIDLSNQSGRVSKLGNETHFLFFGLYPGTTYSFTIRASTAKGFGPPATNQFTTKISAPSMPAYELETPLNQTDNTVTVMLKPAHSRGAPVSVYQIVVEEERPRRTKKTTEILKCYPVPIHFQNASLLNSQYYFAAEFPADSLQAAQPFTIGDNKTYNGYWNTPLLPYKSYRIYFQAASRANGETKIDCVQVATKGAATPKPVPEPEKQTDHTVK

SEQ ID NO: 2919 - protein, 575 aa, synthetic construct
  REGION 1..575: note = PTPRN (Q16849) SP+PP+ECD
MRRPRRPGGLGGSGGLRLLLCLLLLSSRPGGCSAVSAHGCLFDRRLCSHLEVCIQDGLFGQCQVGVGQARPLLQVTSPVLQRLQGVLRQLMSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSLSYEPALLQPYLFHQFGSRDGSRVSEGSPGMVSVGPLPKAEAPALFSRTASKGIFGDHPGHSYGDLPGPSPAQLFQDSGLLYLAQELPAPSRARVPRLPEQGSSSRAEDSPEGYEKEGLGDRGEKPASPAVQPDAALQRLAAVLAGYGVELRQLTPEQLSTLLTLLQLLPKGAGRNPGGVVNVGADIKKTMEGPVEGRDTAELPARTSPMPGHPTASPTSSEVQQVPSPVSSEPPKAARPPVTPVLLEKKSPLGQSQPTVAGQPSARPAAEEYGYIVTDQKPLSLAAGVKLLEILAEHVHMSSGSFINISVVGPALTFRIRHNEQNLSLADVTQQAGLVKSELEAQTGLQILQTGVGQREEAAAVLPQTAHSTSPMR

SEQ ID NO: 2920 - protein, 615 aa, synthetic construct
  REGION 1..615: note = PTPRN2 (Q92932) SP+PP+ECD
MGPPLPLLLLLLLLLPPRVLPAAPSSVPRGRQLPGRLGCLLEEGLCGASEACVNDGVFGRCQKVPAMDFYRYEVSPVALQRLRVALQKLSGTGFTWQDDYTQYVMDQELADLPKTYLRRPEASSPARPSKHSVGSERRYSREGGAALANALRRHLPFLEALSQAPASDVLARTHTAQDRPPAEGDDRFSESILTYVAHTSALTYPPGSRTQLREDLLPRTLGQLQPDELSPKVDSGVDRHHLMAALSAYAAQRPPAPPGEGSLEPQYLLRAPSRMPRPLLAPAAPQKWPSPLGDSEDPSSTGDGARIHTLLKDLQRQPAEVRGLSGLELDGMAELMAGLMQGVDHGVARGSPGRAALGESGEQADGPKATLRGDSFPDDGVQDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDRDPLRPEEGRRLVEDVARLLQVPSSAFADVEVLGPAVTFKVSANVQNVTTEDVEKATVDNKDKLEETSGLKILQTGVGSKSKLKFLPPQAEQEDSTKF

SEQ ID NO: 2921 - protein, 822 aa, synthetic construct
  REGION 1..822: note = PTPRO (Q16827) SP+PP+ECD
MGHLPTGIHGARRLLPLLWLFVLFKNATAFHVTVQDDNNIVVSLEASDVISPASVYVVKITGESKNYFFEFEEFNSTLPPPVIFKASYHGLYYIITLVVVNGNVVTKPSRSITVLTKPLPVTSVSIYDYKPSPETGVLFEIHYPEKYNVFTRVNISYWEGKDFRTMLYKDFFKGKTVFNHWLPGMCYSNITFQLVSEATFNKSTLVEYSGVSHEPKQHRTAPYPPQNISVRIVNLNKNNWEEQSGNFPEESFMRSQDTIGKEKLFHFTEETPEIPSGNISSGWPDFNSSDYETTSQPYWWDSASAAPESEDEFVSVLPMEYENNSTLSETEKSTSGSFSFFPVQMILTWLPPKPPTAFDGFHIHIEREENFTEYLMVDEEAHEFVAELKEPGKYKLSVTTFSSSGSCETRKSQSAKSLSFYISPSGEWIEELTEKPQHVSVHVLSSTTALMSWTSSQENYNSTIVSVVSLTCQKQKESQRLEKQYCTQVNSSKPIIENLVPGAQYQVVIYLRKGPLIGPPSDPVTFAIVPTGIKDLMLYPLGPTAVVLSWTRPYLGVFRKYVVEMFYFNPATMTSEWTTYYEIAATVSLTASVRIANLLPAWYYNFRVTMVTWGDPELSCCDSSTISFITAPVAPEITSVEYFNSLLYISWTYGDDTTDLSHSRMLHWMVVAEGKKKIKKSVTRNVMTAILSLPPGDIYNLSVTACTERGSNTSMLRLVKLEPAPPKSLFAVNKTQTSVTLLWVEEGVADFFEVFCQQVGSSQKTKLQEPVAVSSHVVTISSLLPATAYNCSVTSFSHDSPSVPTFIAVSTMVTEMNPNVVV

SEQ ID NO: 2922 - protein, 1947 aa, synthetic construct
  REGION 1..1947: note = PTPRQ (Q9UMZ3) SP+PP+ECD
MKKVPIKPEQPEKLRAFNISTHSFSLHWSLPSGHVERYQVDLVPDSGFVTIRDLGGGEYQVDVSNVVPGTRYDITISSISTTYTSPVTRIVTTNVTKPGPPVFLAGERVGSAGILLSWNTPPNPNGRIISYIVKYKEVCPWMQTVYTQVRSKPDSLEVLLTNLNPGTTYEIKVAAENSAGIGVFSDPFLFQTAESAPGKVVNLTVEAYNASAVKLIWYLPRQPNGKITSFKISVKHARSGIVVKDVSIRVEDILTGKLPECNENSESFLWSTASPSPTLGRVTPPSRTTHSSSTLTQNEISSVWKEPISFVVTHLRPYTTYLFEVSAVTTEAGYIDSTIVRTPESVPEGPPQNCVTGNITGKSFSILWDPPTIVTGKFSYRVELYGPSGRILDNSTKDLKFAFTNLTPFTMYDVYIAAETSAGTGPKSNISVFTPPDVPGAVFDLQLAEVESTQVRITWKKPRQPNGIINQYRVKVLVPETGIILENTLLTGNNEYINDPMAPEIVNIVEPMVGLYEGSAEMSSDLHSLATFIYNSHPDKNFPARNRAEDQTSPVVTTRNQYITDIAAEQLSYVIRRLVPFTEHMISVSAFTIMGEGPPTVLSVRTRQQVPSSIKIINYKNISSSSILLYWDPPEYPNGKITHYTIYAMELDTNRAFQITTIDNSFLITGLKKYTKYKMRVAASTHVGESSLSEENDIFVRTSEDEPESSPQDVEVIDVTADEIRLKWSPPEKPNGIIIAYEVLYKNIDTLYMKNTSTTDIILRNLRPHTLYNISVRSYTRFGHGNQVSSLLSVRTSETVPDSAPENITYKNISSGEIELSFLPPSSPNGIIKKYTIYLKRSNGNEERTINTTSLTQNIKVLKKYTQYIIEVSASTLKGEGVRSAPISILTEEDAPDSPPQDFSVKQLSGVTVKLSWQPPLEPNGIILYYTVYVWNRSSLKTINVTETSLELSDLDYNVEYSAYVTASTRFGDGKTRSNIISFQTPEGAPSDPPKDVYYANLSSSSIILFWTPPSKPNGIIQYYSVYYRNTSGTFMQNFTLHEVTNDFDNMTVSTIIDKLTIFSYYTFWLTASTSVGNGNKSSDIIEVYTDQDIPEGFVGNLTYESISSTAINVSWVPPAQPNGLVFYYVSLILQQTPRHVRPPLVTYERSIYFDNLEKYTDYILKITPSTEKGFSDTYTAQLYIKTEEDVPETSPIINTFKNLSSTSVLLSWDPPVKPNGAIISYDLTLQGPNENYSFITSDNYIILEELSPFTLYSFFAAARTRKGLGPSSILFFYTDESVPLAPPQNLTLINCTSDFVWLKWSPSPLPGGIVKVYSFKIHEHETDTIYYKNISGFKTEAKLVGLEPVSTYSIRVSAFTKVGNGNQFSNVVKFTTQESVPDVVQNMQCMATSWQSVLVKWDPPKKANGIITQYMVTVERNSTKVSPQDHMYTFIKLLANTSYVFKVRASTSAGEGDESTCHVSTLPETVPSVPTNIAFSDVQSTSATLTWIRPDTILGYFQNYKITTQLRAQKCKEWESEECVEYQKIQYLYEAHLTEETVYGLKKFRWYRFQVAASTNAGYGNASNWISTKTLPGPPDGPPENVHVVATSPFSISISWSEPAVITGPTCYLIDVKSVDNDEFNISFIKSNEENKTIEIKDLEIFTRYSVVITAFTGNISAAYVEGKSSAEMIVTTLESAPKDPPNNMTFQKIPDEVTKFQLTFLPPSQPNGNIQVYQALVYREDDPTAVQIHNLSIIQKTNTFVIAMLEGLKGGHTYNISVYAVNSAGAGPKVPMRITMDIKAPARPKTKPTPIYDATGKLLVTSTTITIRMPICYYSDDHGPIKNVQVLVTETGAQHDGNVTKWYDAYFNKARPYFTNEGFPNPPCTEGKTKFSGNEEIYIIGADNACMIPGNEDKICNGPLKPKKQYLFKFRATNIMGQFTDSDYSDPVKTLGEGLSERTVE

SEQ ID NO: 2923 - protein, 227 aa, synthetic construct
  REGION 1..227: note = PTPRR (Q15256) SP+PP+ECD
MRRAVCFPALCLLLNLHAAGCFSGNNDHFLAINQKKSGKPVFIYKHSQDIEKSLDIAPQKIYRHSYHSSSEAQVSKRHQIVNSAFPRPAYDPSLNLLAMDGQDLEVENLPIPAANVIVVTLQMDVNKLNITLLRIFRQGVAAALGLLPQQVHINRLIGKKNSIELFVSPINRKTGISDALPSEEVLRSLNINVLHQSLSQFGITEVSPEKNVLQGQHEADKIWSKEG

SEQ ID NO: 2924 - protein, 1282 aa, synthetic construct
  REGION 1..1282: note = PTPRS (Q13332) SP+PP+ECD
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSETFESTPIRGALQIESSEETDQGKYECVATNSAGVRYSSPANLYVRELREVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSKPSAPPQDVKCVSVRSTAILVSWRPPPPETHNGALVGYSVRYRPLGSEDPEPKEVNGIPPTTTQILLEALEKWTQYRITTVAHTEVGPGPESSPVVVRTDEDVPSAPPRKVEAEALNATAIRVLWRSPAPGRQHGQIRGYQVHYVRMEGAEARGPPRIKDVMLADAQWETDDTAEYEMVITNLQPETAYSITVAAYTMKGDGARSKPKVVVTKGAVLGRPTLSVQQTPEGSLLARWEPPAGTAEDQVLGYRLQFGREDSTPLATLEFPPSEDRYTASGVHKGATYVFRLAARSRGGLGEEAAEVLSIPEDTPRGHPQILEAAGNASAGTVLLRWLPPVPAERNGAIVKYTVAVREAGALGPARETELPAAAEPGAENALTLQGLKPDTAYDLQVRAHTRRGPGPFSPPVRYRTFLRDQVSPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEG

SEQ ID NO: 2925 - protein, 747 aa, synthetic construct
  REGION 1..747: note = PTPRT (O14522) SP+PP+ECD
MASLAALALSLLLRLQLPPLPGARAQSAAGGCSFDEHYSNCGYSVALGTNGFTWEQINTWEKPMLDQAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGPPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKGASTQNSNTVEPEKQVDNTVKM

SEQ ID NO: 2926 - protein, 749 aa, synthetic construct
  REGION 1..749: note = PTPRU (Q92729) SP+PP+ECD
MARAQALVLALTFQLCAPETETPAAGCTFEEASDPAVPCEYSQAQYDDFQWEQVRIHPGTRAPADLPHGSYLMVNTSQHAPGQRAHVIFQSLSENDTHCVQFSYFLYSRDGHSPGTLGVYVRVNGGPLGSAVWNMTGSHGRQWHQAELAVSTFWPNEYQVLFEALISPDRRGYMGLDDILLLSYPCAKAPHFSRLGDVEVNAGQNASFQCMAAGRAAEAERFLLQRQSGALVPAAGVRHISHRRFLATFPLAAVSRAEQDLYRCVSQAPRGAGVSNFAELIVKEPPTPIAPPQLLRAGPTYLIIQLNTNSIIGDGPIVRKEIEYRMARGPWAEVHAVSLQTYKLWHLDPDTEYEISVLLTRPGDGGTGRPGPPLISRTKCAEPMRAPKGLAFAEIQARQLTLQWEPLGYNVTRCHTYTVSLCYHYTLGSSHNQTIRECVKTEQGVSRYTIKNLLPYRNVHVRLVLTNPEGRKEGKEVTFQTDEDVPSGIAAESLTFTPLEDMIFLKWEEPQEPNGLITQYEISYQSIESSDPAVNVPGPRRTISKLRNETYHVFSNLHPGTTYLFSVRARTGKGFGQAALTEITTNISAPSFDYADMPSPLGESENTITVLLRPAQGRGAPISVYQVIVEEERARRLRREPGGQDCFPVPLTFEAALARGLVHYFGAELAASSLPEAMPFTVGDNQTYRGFWNPPLEPRKAYLIYFQAASHLKGETRLNCIRIARKAACKESKRPLEVSQRSEEMGLIL

SEQ ID NO: 2927 - protein, 1636 aa, synthetic construct
  REGION 1..1636: note = PTPRZ1 (P23471) SP+PP+ECD
MRILKRFLACIQLLCVCRLDWANGYYRQQRKLVEEIGWSYTGALNQKNWGKKYPTCNSPKQSPINIDEDLTQVNVNLKKLKFQGWDKTSLENTFIHNTGKTVEINLTNDYRVSGGVSEMVFKASKITFHWGKCNMSSDGSEHSLEGQKFPLEMQIYCFDADRFSSFEEAVKGKGKLRALSILFEVGTEENLDFKAIIDGVESVSRFGKQAALDPFILLNLLPNSTDKYYIYNGSLTSPPCTDTVDWIVFKDTVSISESQLAVFCEVLTMQQSGYVMLMDYLQNNFREQQYKFSRQVFSSYTGKEEIHEAVCSSEPENVQADPENYTSLLVTWERPRVVYDTMIEKFAVLYQQLDGEDQTKHEFLTDGYQDLGAILNNLLPNMSYVLQIVAICTNGLYGKYSDQLIVDMPTDNPELDLFPELIGTEEIIKEEEEGKDIEEGAIVNPGRDSATNQIRKKEPQISTTTHYNRIGTKYNEAKTNRSPTRGSEFSGKGDVPNTSLNSTSQPVTKLATEKDISLTSQTVTELPPHTVEGTSASLNDGSKTVLRSPHMNLSGTAESLNTVSITEYEEESLLTSFKLDTGAEDSSGSSPATSAIPFISENISQGYIFSSENPETITYDVLIPESARNASEDSTSSGSEESLKDPSMEGNVWFPSSTDITAQPDVGSGRESFLQTNYTEIRVDESEKTTKSFSAGPVMSQGPSVTDLEMPHYSTFAYFPTEVTPHAFTPSSRQQDLVSTVNVVYSQTTQPVYNGETPLQPSYSSEVFPLVTPLLLDNQILNTTPAASSSDSALHATPVFPSVDVSFESILSSYDGAPLLPFSSASFSSELFRHLHTVSQILPQVTSATESDKVPLHASLPVAGGDLLLEPSLAQYSDVLSTTHAASETLEFGSESGVLYKTLMFSQVEPPSSDAMMHARSSGPEPSYALSDNEGSQHIFTVSYSSAIPVHDSVGVTYQGSLFSGPSHIPIPKSSLITPTASLLQPTHALSGDGEWSGASSDSEFLLPDTDGLTALNISSPVSVAEFTYTTSVFGDDNKALSKSEIIYGNETELQIPSFNEMVYPSESTVMPNMYDNVNKLNASLQETSVSISSTKGMFPGSLAHTTTKVFDHEISQVPENNFSVQPTHTVSQASGDTSLKPVLSANSEPASSDPASSEMLSPSTQLLFYETSASFSTEVLLQPSFQASDVDTLLKTVLPAVPSDPILVETPKVDKISSTMLHLIVSNSASSENMLHSTSVPVFDVSPTSHMHSASLQGLTISYASEKYEPVLLKSESSHQVVPSLYSNDELFQTANLEINQAHPPKGRHVFATPVLSIDEPLNTLINKLIHSDEILTSTKSSVTGKVFAGIPTVASDTFVSTDHSVPIGNGHVAITAVSPHRDGSVTSTKLLFPSKATSELSHSAKSDAGLVGGGEDGDTDDDGDDDDDDRGSDGLSIHKCMSCSSYRESQEKVMNDSDTHENSLMDQNNPISYSLSENSEEDNRVTSVSSDSQTGMDRSPGKSPSANGLSQKHNDGKEENDIQTGSALLPLSPESKAWAVLTSDEESGSGQGTSDSLNENETSTDFSFADTNEKDADGILAAGDSEITPGFPQSPTSSVTSENSEVFHVSEAEASNSSHESRIGLAEGLESEKK

SEQ ID NO: 2928 - protein, 96 aa, synthetic construct
  REGION 1..96: note = PTTG1IP (P53801) SP+PP+ECD
MAPGVARGPTPYWRLRLGGAALLLLLIPVAAAQEPPGAACSQNTNKTCEECLKNVSCLWCNTNKACLDYPVTSVLPPASLCKLSSARWGVCWVNFE

SEQ ID NO: 2929 - protein, 343 aa, synthetic construct
  REGION 1..343: note = PVR (P15151) SP+PP+ECD
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 2930 - protein, 355 aa, synthetic construct
  REGION 1..355: note = PVRL1 (Q15223) SP+PP+ECD
MARMGLAGAAGRWWGLALGLTAFFLPGVHSQVVQVNDSMYGFIGTDVVLHCSFANPLPSVKITQVTWQKSTNGSKQNVAIYNPSMGVSVLAPYRERVEFLRPSFTDGTIRLSRLELEDEGVYICEFATFPTGNRESQLNLTVMAKPTNWIEGTQAVLRAKKGQDDKVLVATCTSANGKPPSVVSWETRLKGEAEYQEIRNPNGTVTVISRYRLVPSREAHQQSLACIVNYHMDRFKESLTLNVQYEPEVTIEGFDGNWYLQRMDVKLTCKADANPPATEYHWTTLNGSLPKGVEAQNRTLFFKGPINYSLAGTYICEATNPIGTRSGQVEVNITEFPYTPSPPEHGRRAGPVPTA

SEQ ID NO: 2931 - protein, 360 aa, synthetic construct
  REGION 1..360: note = PVRL2 (Q92692) SP+PP+ECD
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 2932 - protein, 404 aa, synthetic construct
  REGION 1..404: note = PVRL3 (Q9NQS3) SP+PP+ECD
MARTLRPSPLCPGGGKAQLSSASLLGAGLLLQPPTPPPLLLLLFPLLLFSRLCGALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKGPDSLIDGGNETVAAICIAATGKPVAHIDWEGDLGEMESTTTSFPNETATIISQYKLFPTRFARGRRITCVVKHPALEKDIRYSFILDIQYAPEVSVTGYDGNWFVGRKGVNLKCNADANPPPFKSVWSRLDGQWPDGLLASDNTLHFVHPLTFNYSGVYICKVTNSLGQRSDQKVIYISDPPTTTTLQPTIQWHPSTADIEDLATEPKKLPFPLSTLATIKDDTIAT

SEQ ID NO: 2933 - protein, 349 aa, synthetic construct
  REGION 1..349: note = PVRL4 (Q96NY8) SP+PP+ECD
MPLSLGAEMWGPEAWLLLLLLLASFTGRCPAGELETSDVVTVVLGQDAKLPCFYRGDSGEQVGQVAWARVDAGEGAQELALLHSKYGLHVSPAYEGRVEQPPPPRNPLDGSVLLRNAVQADEGEYECRVSTFPAGSFQARLRLRVLVPPLPSLNPGPALEEGQGLTLAASCTAEGSPAPSVTWDTEVKGTTSSRSFKHSRSAAVTSEFHLVPSRSMNGQPLTCVVSHPGLLQDQRITHILHVSFLAEASVRGLEDQNLWHIGREGAMLKCLSEGQPPPSYNWTRLDGPLPSGVRVDGDTLGFPPLTTEHSGIYVCHVSNEFSSRDSQVTVDVLDPQEDSGKQVDLVSAS

SEQ ID NO: 2934 - protein, 709 aa, synthetic construct
  REGION 1..709: note = QSOX1 (O00391) SP+PP+ECD
MRRCNSGSGPPPSLLLLLLWLLAVPGANAAPRSALYSPSDPLTLLQADTVRGAVLGSRSAWAVEFFASWCGHCIAFAPTWKALAEDVKAWRPALYLAALDCAEETNSAVCRDFNIPGFPTVRFFKAFTKNGSGAVFPVAGADVQTLRERLIDALESHHDTWPPACPPLEPAKLEEIDGFFARNNEEYLALIFEKGGSYLGREVALDLSQHKGVAVRRVLNTEANVVRKFGVTDFPSCYLLFRNGSVSRVPVLMESRSFYTAYLQRLSGLTREAAQTTVAPTTANKIAPTVWKLADRSKIYMADLESALHYILRIEVGRFPVLEGQRLVALKKFVAVLAKYFPGRPLVQNFLHSVNEWLKRQKRNKIPYSFFKTALDDRKEGAVLAKKVNWIGCQGSEPHFRGFPCSLWVLFHFLTVQAARQNVDHSQEAAKAKEVLPAIRGYVHYFFGCRDCASHFEQMAAASMHRVGSPNAAVLWLWSSHNRVNARLAGAPSEDPQFPKVQWPPRELCSACHNERLDVPVWDVEATLNFLKAHFSPSNIILDFPAAGSAARRDVQNVAAAPELAMGALELESRNSTLDPGKPEMMKSPTNTTPHVPAEGPEASRPPKLHPGLRAAPGQEPPEHMAELQRNEQEQPLGQWHLSKRDTGAALLAESRAEKNRLWGPLEVRRVGRSSKQLVDIPEGQLEARAGRGRGQWLQVLGGGFSYLD

SEQ ID NO: 2935 - protein, 661 aa, synthetic construct
  REGION 1..661: note = QSOX2 (Q6ZRP7) SP+PP+ECD
MAAAGAAVARSPGIGAGPALRARRSPPPRAARLPRLLVLLAAAAVGPGAGGAARLYRAGEDAVWVLDSGSVRGATANSSAAWLVQFYSSWCGHCIGYAPTWRALAGDVRDWASAIRVAALDCMEEKNQAVCHDYDIHFYPTFRYFKAFTKEFTTGENFKGPDRELRTVRQTMIDFLQNHTEGSRPPACPRLDPIQPSDVLSLLDNRGSHYVAIVFESNSSYLGREVILDLIPYESIVVTRALDGDKAFLEKLGVSSVPSCYLIYPNGSHGLINVVKPLRAFFSSYLKSLPDVRKKSLPLPEKPHKEENSEIVVWREFDKSKLYTVDLESGLHYLLRVELAAHKSLAGAELKTLKDFVTVLAKLFPGRPPVKKLLEMLQEWLASLPLDRIPYNAVLDLVNNKMRISGIFLTNHIKWVGCQGSRSELRGYPCSLWKLFHTLTVEASTHPDALVGTGFEDDPQAVLQTMRRYVHTFFGCKECGEHFEEMAKESMDSVKTPDQAILWLWKKHNMVNGRLAGHLSEDPRFPKLQWPTPDLCPACHEEIKGLASWDEGHVLTFLKQHYGRDNLLDTYSADQGDSSEGGTLARGEEEEKRLTPPEVSHGDRDTQSVRPPGALGPRPALPESLHHSLDGKLQSLDGPGAHKEVGGAAPFLGVDFSSLDM

SEQ ID NO: 2936 - protein, 225 aa, synthetic construct
  REGION 1..225: note = RAET1E (Q8TD07) SP+PP+ECD
MRRISLTSSPVRLLLFLLLLLIALEIMVGGHSLCFNFTIKSLSRPGQPWCEAQVFLNKNLFLQYNSDNNMVKPLGLLGKKVYATSTWGELTQTLGEVGRDLRMLLCDIKPQIKTSDPSTLQVEMFCQREAERCTGASWQFATNGEKSLLFDAMNMTWTVINHEASKIKETWKKDRGLEKYFRKLSKGDCDHWLREFLGHWEAMPEPTVSPVNASDIHWSSSSLPD

SEQ ID NO: 2937 - protein, 223 aa, synthetic construct
  REGION 1..223: note = RAET1G (Q6H3X3) SP+PP+ECD
MAAAASPAFLLRLPLLLLLSSWCRTGLADPHSLCYDITVIPKFRPGPRWCAVQGQVDEKTFLHYDCGSKTVTPVSPLGKKLNVTTAWKAQNPVLREVVDILTEQLLDIQLENYIPKEPLTLQARMSCEQKAEGHGSGSWQLSFDGQIFLLFDSENRMWTTVHPGARKMKEKWENDKDMTMSFHYISMGDCTGWLEDFLMGMDSTLEPSAGAPPTMSSGTAQPR

SEQ ID NO: 2938 - protein, 145 aa, synthetic construct
  REGION 1..145: note = RAMP2 (O60895) SP+PP+ECD
MASLRVERAGGPRLPRTRVGRPAALRLLLLLGAVLNPHEALAQPLPTTGTPGSEGGTVKNYETAVQFCWNHYKDQMDPIEKDWCDWAMISRPYSTLRDCLEHFAELFDLGFPNPLAERIIFETHQIHFANCSLVQPTFSDPPEDV

SEQ ID NO: 2939 - protein, 118 aa, synthetic construct
  REGION 1..118: note = RAMP3 (O60896) SP+PP+ECD
METGALRRPQLLPLLLLLCGGCPRAGGCNETGMLERLPLCGKAFADMMGKVDVWKWCNLSEFIVYYESFTNCTEMEANVVGCYWPNPLAQGFITGIHRQFFSNCTVDRVHLEDPPDEV

SEQ ID NO: 2940 - protein, 57 aa, synthetic construct
  REGION 1..57: note = RELL1 (Q8IUW5) SP+PP+ECD
MAPRALPGSAVLAAAVFVGGAVSSPLVAPDNGSSRTLHSRTETTPSPSNDTGNGHPE

SEQ ID NO: 2941 - protein, 162 aa, synthetic construct
  REGION 1..162: note = RELT (Q969Z4) SP+PP+ECD
MKPSLLCRPLSCFLMLLPWPLATLTSTTLWQCPPGEEPDLDPGQGTLCRPCPPGTFSAAWGSSPCQPHARCSLWRRLEAQVGMATRDTLCGDCWPGWFGPWGVPRVPCQPCSWAPLGTHGCDEWGRRARRGVEVAAGASSGGETRQPGNGTRAGGPEETAAQ

SEQ ID NO: 2942 - protein, 635 aa, synthetic construct
  REGION 1..635: note = RET (P07949) SP+PP+ECD
MAKATSGAAGLRLLLLLLLPLLGKVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCQAFSGINVQYKLHSSGANCSTLGVVTSAEDTSGILFVNDTKALRRPKCAELHYMVVATDQQTSRQAQAQLLVTVEGSYVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCR

SEQ ID NO: 2943 - protein, 207 aa, synthetic construct
  REGION 1..207: note = RNF128 (Q8TEB7) SP+PP+ECD
MGPPPGAGVSCRGGCGFSRLLAWCFLLALSPQAPGSRGAEAVWTAYLNVSWRVPHTGVNRTVWELSEEGVYGQDSPLEPVAGVLVPPDGPGALNACNPHTNFTVPTVWGSTVQVSWLALIQRGGGCTFADKIHLAYERGASGAVIFNFPGTRNEVIPMSHPGAVDIVAIMIGNLKGTKILQSIQRGIQVTMVIEVGKKHGPWVNHYS

SEQ ID NO: 2944 - protein, 182 aa, synthetic construct
  REGION 1..182: note = RNF13 (O43567) SP+PP+ECD
MLLSIGMLMLSATQVYTILTVQLFAFLNLLPVEADILAYNFENASQTFDDLPARFGYRLPAEGLKGFLINSKPENACEPIVPPPVKDNSSGTFIVLIRRLDCNFDIKVLNAQRAGYKAAIVHNVDSDDLISMGSNDIEVLKKIDIPSVFIGESSANSLKDEFTYEKGGHLILVPEFSLPLEY

SEQ ID NO: 2945 - protein, 194 aa, synthetic construct
  REGION 1..194: note = RNF130 (Q86XS8) SP+PP+ECD
MSCAGRAGPARLAALALLTCSLWPARADNASQEYYTALINVTVQEPGRGAPLTFRIDRGRYGLDSPKAEVRGQVLAPLPLHGVADHLGCDPQTRFFVPPNIKQWIALLQRGNCTFKEKISRAAFHNAVAVVIYNNKSKEEPVTMTHPGTGDIIAVMITELRGKDILSYLEKNISVQMTIAVGTRMPPKNFSRGS

SEQ ID NO: 2946 - protein, 200 aa, synthetic construct
  REGION 1..200: note = RNF149 (Q8NC42) SP+PP+ECD
MAWRRREASVGARGVLALALLALALCVPGARGRALEWFSAVVNIEYVDPQTNLTVWSVSESGRFGDSSPKEGAHGLVGVPWAPGGDLEGCAPDTRFFVPEPGGRGAAPWVALVARGGCTFKDKVLVAARRNASAVVLYNEERYGNITLPMSHAGTGNIVVIMISYPKGREILELVQKGIPVTMTIGVGTRHVQEFISGQS

SEQ ID NO: 2947 - protein, 208 aa, synthetic construct
  REGION 1..208: note = RNF150 (Q9ULK6) SP+PP+ECD
MAMSLIQACCSLALSTWLLSFCFVHLLCLDFTVAEKEEWYTAFVNITYAEPAPDPGAGAAGGGGAELHTEKTECGRYGEHSPKQDARGEVVMASSAHDRLACDPNTKFAAPTRGKNWIALIPKGNCTYRDKIRNAFLQNASAVVIFNVGSNTNETITMPHAGVEDIVAIMIPEPKGKEIVSLLERNITVTMYITIGTRNLQKYVSRTS

SEQ ID NO: 2948 - protein, 173 aa, synthetic construct
  REGION 1..173: note = RNF167 (Q9H6Y7) SP+PP+ECD
MHPAAFPLPVVVAAVLWGAAPTRGLIRATSDHNASMDFADLPALFGATLSQEGLQGFLVEAHPDNACSPIAPPPPAPVNGSVFIALLRRFDCNFDLKVLNAQKAGYGAAVVHNVNSNELLNMVWNSEEIQQQIWIPSVFIGERSSEYLRALFVYEKGARVLLVPDNTFPLGYY

SEQ ID NO: 2949 - protein, 197 aa, synthetic construct
  REGION 1..197: note = RNF43 (Q68DV7) SP+PP+ECD
MSGGHQLQLAALWPWLLMATLQAGFGRTGLVLAAAVESERSAEQKAIIRVIPLKMDPTGKLNLTLEGVFAGVAEITPAEGKLMQSHPLYLCNASDDDNLEPGFISIVKLESPRRAPRPCLSLASKARMAGERGASAVLFDITEDRAAAEQLQQPLGLTWPVVLIWGNDAEKLMEFVYKNQKAHVRIELKEPPAWPDY

SEQ ID NO: 2950 - protein, 897 aa, synthetic construct
  REGION 1..897: note = ROBO1 (Q9Y6N7) SP+PP+ECD
MKWKHVPFLVMISLLSLSPNHLFLAQLIPDPEDVERGNDHGTPIPTSDNDDNSLGYTGSRLRQEDFPPRIVEHPSDLIVSKGEPATLNCKAEGRPTPTIEWYKGGERVETDKDDPRSHRMLLPSGSLFFLRIVHGRKSRPDEGVYVCVARNYLGEAVSHNASLEVAILRDDFRQNPSDVMVAVGEPAVMECQPPRGHPEPTISWKKDGSPLDDKDERITIRGGKLMITYTRKSDAGKYVCVGTNMVGERESEVAELTVLERPSFVKRPSNLAVTVDDSAEFKCEARGDPVPTVRWRKDDGELPKSRYEIRDDHTLKIRKVTAGDMGSYTCVAENMVGKAEASATLTVQEPPHFVVKPRDQVVALGRTVTFQCEATGNPQPAIFWRREGSQNLLFSYQPPQSSSRFSVSQTGDLTITNVQRSDVGYYICQTLNVAGSIITKAYLEVTDVIADRPPPVIRQGPVNQTVAVDGTFVLSCVATGSPVPTILWRKDGVLVSTQDSRIKQLENGVLQIRYAKLGDTGRYTCIASTPSGEATWSAYIEVQEFGVPVQPPRPTDPNLIPSAPSKPEVTDVSRNTVTLSWQPNLNSGATPTSYIIEAFSHASGSSWQTVAENVKTETSAIKGLKPNAIYLFLVRAANAYGISDPSQISDPVKTQDVLPTSQGVDHKQVQRELGNAVLHLHNPTVLSSSSIEVHWTVDQQSQYIQGYKILYRPSGANHGESDWLVFEVRTPAKNSVVIPDLRKGVNYEIKARPFFNEFQGADSEIKFAKTLEEAPSAPPQGVTVSKNDGNGTAILVSWQPPPEDTQNGMVQEYKVWCLGNETRYHINKTVDGSTFSVVIPFLVPGIRYSVEVAASTGAGSGVKSEPQFIQLDAHGNPVSPEDQVSLAQQISDVVKQP

SEQ ID NO: 2951 - protein, 859 aa, synthetic construct
  REGION 1..859: note = ROBO2 (Q9HCK4) SP+PP+ECD
MSLLMFTQLLLCGFLYVRVDGSRLRQEDFPPRIVEHPSDVIVSKGEPTTLNCKAEGRPTPTIEWYKDGERVETDKDDPRSHRMLLPSGSLFFLRIVHGRRSKPDEGSYVCVARNYLGEAVSRNASLEVALLRDDFRQNPTDVVVAAGEPAILECQPPRGHPEPTIYWKKDKVRIDDKEERISIRGGKLMISNTRKSDAGMYTCVGTNMVGERDSDPAELTVFERPTFLRRPINQVVLEEEAVEFRCQVQGDPQPTVRWKKDDADLPRGRYDIKDDYTLRIKKTMSTDEGTYMCIAENRVGKMEASATLTVRAPPQFVVRPRDQIVAQGRTVTFPCETKGNPQPAVFWQKEGSQNLLFPNQPQQPNSRCSVSPTGDLTITNIQRSDAGYYICQALTVAGSILAKAQLEVTDVLTDRPPPIILQGPANQTLAVDGTALLKCKATGDPLPVISWLKEGFTFPGRDPRATIQEQGTLQIKNLRISDTGTYTCVATSSSGETSWSAVLDVTESGATISKNYDLSDLPGPPSKPQVTDVTKNSVTLSWQPGTPGTLPASAYIIEAFSQSVSNSWQTVANHVKTTLYTVRGLRPNTIYLFMVRAINPQGLSDPSPMSDPVRTQDISPPAQGVDHRQVQKELGDVLVRLHNPVVLTPTTVQVTWTVDRQPQFIQGYRVMYRQTSGLQATSSWQNLDAKVPTERSAVLVNLKKGVTYEIKVRPYFNEFQGMDSESKTVRTTEEAPSAPPQSVTVLTVGSYNSTSISVSWDPPPPDHQNGIIQEYKIWCLGNETRFHINKTVDAAIRSVIIGGLFPGIQYRVEVAASTSAGVGVKSEPQPIIIGRRNEVVITENNNSITEQITDVVKQP

SEQ ID NO: 2952 - protein, 891 aa, synthetic construct
  REGION 1..891: note = ROBO3 (Q96MS0) SP+PP+ECD
MLRYLLKTLLQMNLFADSLAGDISNSSELLLGFNSSLAALNHTLLPPGDPSLNGSRVGPEDAMPRIVEQPPDLLVSRGEPATLPCRAEGRPRPNIEWYKNGARVATVREDPRAHRLLLPSGALFFPRIVHGRRARPDEGVYTCVARNYLGAAASRNASLEVAVLRDDFRQSPGNVVVAVGEPAVLECVPPRGHPEPSVSWRKDGARLKEEEGRITIRGGKLMMSHTLKSDAGMYVCVASNMAGERESAAAEVMVLERPSFLRRPVNQVVLADAPVTFLCEVKGDPPPRLRWRKEDGELPTGRYEIRSDHSLWIGHVSAEDEGTYTCVAENSVGRAEASGSLSVHVPPQLVTQPQDQMAAPGESVAFQCETKGNPPPAIFWQKEGSQVLLFPSQSLQPTGRFSVSPRGQLNITAVQRGDAGYYVCQAVSVAGSILAKALLEIKGASLDGLPPVILQGPANQTLVLGSSVWLPCRVTGNPQPSVRWKKDGQWLQGDDLQFKTMANGTLYIANVQEMDMGFYSCVAKSSTGEATWSGWLKMREDWGVSPDPPTEPSSPPGAPSQPVVTEITKNSITLTWKPNPQTGAAVTSYVIEAFSPAAGNTWRTVADGVQLETHTVSGLQPNTIYLFLVRAVGAWGLSEPSPVSEPVRTQDSSPSRPVEDPWRGQQGLAEVAVRLQEPIVLGPRTLQVSWTVDGPVQLVQGFRVSWRVAGPEGGSWTMLDLQSPSQQSTVLRGLPPGTQIQIKVQAQGQEGLGAESLSVTRSIPEEAPSGPPQGVAVALGGDGNSSITVSWEPPLPSQQNGVITEYQIWCLGNESRFHLNRSAAGWARSAMLRGLVPGLLYRTLVAAATSAGVGVPSAPVLVQLPSPPDLEPGLEVGAGLAVRLARVLREP

SEQ ID NO: 2953 - protein, 406 aa, synthetic construct
  REGION 1..406: note = ROR1 (Q01973) SP+PP+ECD
MHRPRRRGTRPPLLALLAALLLAARGAAAQETELSVSAELVPTSSWNISSELNKDSYLTLDEPMNNITTSLGQTAELHCKVSGNPPPTIRWFKNDAPVVQEPRRLSFRSTIYGSRLRIRNLDTTDTGYFQCVATNGKEVVSSTGVLFVKFGPPPTASPGYSDEYEEDGFCQPYRGIACARFIGNRTVYMESLHMQGEIENQITAAFTMIGTSSHLSDKCSQFAIPSLCHYAFPYCDETSSVPKPRDLCRDECEILENVLCQTEYIFARSNPMILMRLKLPNCEDLPQPESPEAANCIRIGIPMADPINKNHKCYNSTGVDYRGTVSVTKSGRQCQPWNSQYPHTHTFTALRFPELNGGHSYCRNPGNQKEAPWCFTLDENFKSDLCDIPACDSKDSKEKNKMEILY

SEQ ID NO: 2954 - protein, 403 aa, synthetic construct
  REGION 1..403: note = ROR2 (Q01974) SP+PP+ECD
MARGSALPRRPLLCIPAVWAAAALLLSVSRTSGEVEVLDPNDPLGPLDGQDGPIPTLKGYFLNFLEPVNNITIVQGQTAILHCKVAGNPPPNVRWLKNDAPVVQEPRRIIIRKTEYGSRLRIQDLDTTDTGYYQCVATNGMKTITATGVLFVRLGPTHSPNHNFQDDYHEDGFCQPYRGIACARFIGNRTIYVDSLQMQGEIENRITAAFTMIGTSTHLSDQCSQFAIPSFCHFVFPLCDARSRTPKPRELCRDECEVLESDLCRQEYTIARSNPLILMRLQLPKCEALPMPESPDAANCMRIGIPAERLGRYHQCYNGSGMDYRGTASTTKSGHQCQPWALQHPHSHHLSSTDFPELGGGHAYCRNPGGQMEGPWCFTQNKNVRMELCDVPSCSPRDSSKMG

SEQ ID NO: 2955 - protein, 1859 aa, synthetic construct
  REGION 1..1859: note = ROS1 (P08922) SP+PP+ECD
MKNIYCLIPKLVNFATLGCLWISVVQCTVLNSCLKSCVTNLGQQLDLGTPHNLSEPCIQGCHFWNSVDQKNCALKCRESCEVGCSSAEGAYEEEVLENADLPTAPFASSIGSHNMTLRWKSANFSGVKYIIQWKYAQLLGSWTYTKTVSRPSYVVKPLHPFTEYIFRVVWIFTAQLQLYSPPSPSYRTHPHGVPETAPLIRNIESSSPDTVEVSWDPPQFPGGPILGYNLRLISKNQKLDAGTQRTSFQFYSTLPNTIYRFSIAAVNEVGEGPEAESSITTSSSAVQQEEQWLFLSRKTSLRKRSLKHLVDEAHCLRLDAIYHNITGISVDVHQQIVYFSEGTLIWAKKAANMSDVSDLRIFYRGSGLISSISIDWLYQRMYFIMDELVCVCDLENCSNIEEITPPSISAPQKIVADSYNGYVFYLLRDGIYRADLPVPSGRCAEAVRIVESCTLKDFAIKPQAKRIIYFNDTAQVFMSTFLDGSASHLILPRIPFADVKSFACENNDFLVTDGKVIFQQDALSFNEFIVGCDLSHIEEFGFGNLVIFGSSSQLHPLPGRPQELSVLFGSHQALVQWKPPALAIGANVILISDIIELFELGPSAWQNWTYEVKVSTQDPPEVTHIFLNISGTMLNVPELQSAMKYKVSVRASSPKRPGPWSEPSVGTTLVPASEPPFIMAVKEDGLWSKPLNSFGPGEFLSSDIGNVSDMDWYNNSLYYSDTKGDVFVWLLNGTDISENYHLPSIAGAGALAFEWLGHFLYWAGKTYVIQRQSVLTGHTDIVTHVKLLVNDMVVDSVGGYLYWTTLYSVESTRLNGESSLVLQTQPWFSGKKVIALTLDLSDGLLYWLVQDSQCIHLYTAVLRGQSTGDTTITEFAAWSTSEISQNALMYYSGRLFWINGFRIITTQEIGQKTSVSVLEPARFNQFTIIQTSLKPLPGNFSFTPKVIPDSVQESSFRIEGNASSFQILWNGPPAVDWGVVFYSVEFSAHSKFLASEQHSLPVFTVEGLEPYALFNLSVTPYTYWGKGPKTSLSLRAPETVPSAPENPRIFILPSGKCCNKNEVVVEFRWNKPKHENGVLTKFEIFYNISNQSITNKTCEDWIAVNVTPSVMSFQLEGMSPRCFIAFQVRAFTSKGPGPYADVVKSTTSEINPFPHLITLLGNKIVFLDMDQNQVVWTFSAERVISAVCYTADNEMGYYAEGDSLFLLHLHNRSSSELFQDSLVFDITVITIDWISRHLYFALKESQNGMQVFDVDLEHKVKYPREVKIHNRNSTIISFSVYPLLSRLYWTEVSNFGYQMFYYSIISHTLHRILQPTATNQQNKRNQCSCNVTEFELSGAMAIDTSNLEKPLIYFAKAQEIWAMDLEGCQCWRVITVPAMLAGKTLVSLTVDGDLIYWIITAKDSTQIYQAKKGNGAIVSQVKALRSRHILAYSSVMQPFPDKAFLSLASDTVEPTILNATNTSLTIRLPLAKTNLTWYGITSPTPTYLVYYAEVNDRKNSSDLKYRILEFQDSIALIEDLQPFSTYMIQIAVKNYYSDPLEHLPPGKEIWGKTKNGVPEAVQLINTTVRSDTSLIISWRESHKPNGPKESVRYQLAISHLALIPETPLRQSEFPNGRLTLLVTRLSGGNIYVLKVLACHSEEMWCTESHPVTVEMFNTPEKPYSLVPENTSLQFNWKAPLNVNLIRFWVELQKWKYNEFYHVKTSCSQGPAYVCNITNLQPYTSYNVRVVVVYKTGENSTSLPESFKTKAGVPNKPGIPKLLEGSKNSIQWEKAEDNGCRITYYILEIRKSTSNNLQNQNLRWKMTFNGSCSSVCTWKSKNLKGIFQFRVVAANNLGFGEYSGISENIILVGDDFWIPE

SEQ ID NO: 2956 - protein, 438 aa, synthetic construct
  REGION 1..438: note = RPN1 (P04843) SP+PP+ECD
MEAPAAGLFLLLLLGTWAPAPGSASSEAPPLINEDVKRTVDLSSHLAKVTAEVVLAHLGGGSTSRATSFLLALEPELEARLAHLGVQVKGEDEEENNLEVRETKIKGKSGRFFTVKLPVALDPGAKISVIVETVYTHVLHPYPTQITQSEKQFVVFEGNHYFYSPYPTKTQTMRVKLASRNVESYTKLGNPTRSEDLLDYGPFRDVPAYSQDTFKVHYENNSPFLTITSMTRVIEVSHWGNIAVEENVDLKHTGAVLKGPFSRYDYQRQPDSGISSIRSFKTILPAAAQDVYYRDEIGNVSTSHLLILDDSVEMEIRPRFPLFGGWKTHYIVGYNLPSYEYLYNLGDQYALKMRFVDHVFDEQVIDSLTVKIILPEGAKNIEIDSPYEISRAPDELHYTYLDTFGRPVIVAYKKNLVEQHIQDIVVHYTFNKVLMLQE

SEQ ID NO: 2957 - protein, 227 aa, synthetic construct
  REGION 1..227: note = RYK (P34925) SP+PP+ECD
MRGAARLGRPGRSCLPGARGLRAPPPPPLLLLLALLPLLPAPGAAAAPAPRPPELQSASAGPSVSLYLSEDEVRRLIGLDAELYYVRNDLISHYALSFSLLVPSETNFLHFTWHAKSKVEYKLGFQVDNVLAMDMPQVNISVQGEVPRTLSVFRVELSCTGKVDSEVMILMQLNLTVNSSKNFTVLNFKRRKMCYKKLEEVKTSALDKNTSRTIYDPVHAAPTTSTR

SEQ ID NO: 2958 - protein, 421 aa, synthetic construct
  REGION 1..421: note = SCARF1 (Q14162) SP+PP+ECD
MGLGLLLPLLLLWTRGTQGSELDPKGQHVCVASSPSAELQCCAGWRQKDQECTIPICEGPDACQKDEVCVKPGLCRCKPGFFGAHCSSRCPGQYWGPDCRESCPCHPHGQCEPATGACQCQADRWGARCEFPCACGPHGRCDPATGVCHCEPGWWSSTCRRPCQCNTAAARCEQATGACVCKPGWWGRRCSFRCNCHGSPCEQDSGRCACRPGWWGPECQQQCECVRGRCSAASGECTCPPGFRGARCELPCPAGSHGVQCAHSCGRCKHNEPCSPDTGSCESCEPGWNGTQCQQPCLPGTFGESCEQQCPHCRHGEACEPDTGHCQRCDPGWLGPRCEDPCPTGTFGEDCGSTCPTCVQGSCDTVTGDCVCSAGYWGPSCNASCPAGFHGNNCSVPCECPEGLCHPVSGSCQPGSGSRDT

SEQ ID NO: 2959 - protein, 441 aa, synthetic construct
  REGION 1..441: note = SCARF2 (Q96GP6) SP+PP+ECD
MEGAGPRGAGPARRRGAGGPPSPLLPSLLLLLLLWMLPDTVAPQELNPRGRNVCRAPGSQVPTCCAGWRQQGDECGIAVCEGNSTCSENEVCVRPGECRCRHGYFGANCDTKCPRQFWGPDCKELCSCHPHGQCEDVTGQCTCHARRWGARCEHACQCQHGTCHPRSGACRCEPGWWGAQCASACYCSATSRCDPQTGACLCHAGWWGRSCNNQCACNSSPCEQQSGRCQCRERTFGARCDRYCQCFRGRCHPVDGTCACEPGYRGKYCREPCPAGFYGLGCRRRCGQCKGQQPCTVAEGRCLTCEPGWNGTKCDQPCATGFYGEGCSHRCPPCRDGHACNHVTGKCTRCNAGWIGDRCETKCSNGTYGEDCAFVCADCGSGHCDFQSGRCLCSPGVHGPHCNVTCPPGLHGADCAQACSCHEDTCDPVTGACHLETNQRK

SEQ ID NO: 2960 - protein, 906 aa, synthetic construct
  REGION 1..906: note = SCART1 (Q4G0T1) SP+PP+ECD
MRAALWTLGLGPLLLNLWAVPIGGPGALRLAYRHSTCDGVVLVRHHGAWGYVCNQEWTLAEASVVCRQLGCGPAVGAPKYVPLPGEMAQPWLHNVSCRGNESSLWECSLGSWCQSPCPHAWVVVALCSNGTFRELRLVKGRSPCAGLPEIRNVNGVDRLCVLHVEEAMVFCRELGCGPVLQAPRRDVGVVRKYLACRGTEPTIRSCRLDNNFRSGCDLRLDAEVVCSGHTEARLVGGEHPCAGRLEVTWGTVCDAALDLATAHVVCRELQCGAVVSTPEGARFGRGSGPVWTEAFRCAGNESLLFHCPRGRGSQCGHGHDAGLRCSEFRMVNGSSSCEGRVEFQVQGSWAPLCATHWDIADATVLCHQLNCGNAVAAPGGGHFGDGDAAIWPDAFHCEGTESYLWNCPVSTLGAPACAPGNTASAVCSGLAHALRLREGQSRCDGRVEVSLDGVWGRVLDDAWDLRGAGVVCRQLGCRGAQQAYDAPAPSRGSVQVALSRVRCLGTETRLTQCNVSATLQEPAGTSRDAGVVCSGEVGTASPMARRHGIPGALTLSLHREPQGAAGRGAGALHGGAWGTVCDDAWDLRDAHVVCRQLGCGRALSALGAAHFGAGAGRIWLDELGCQGHESALWQCPSAGWGRHDWRHKEDAGVFCSESVALRLRGGTCCCAGWLDVFYNGTWGAMCSNALKDLSLSIICKQLGCGVWGVGLAGEQALPLCGHRDRLGGQHRVPQAAQLHSVAMPFPPMAPALLRPSRAGLSEDRPQAAGEPLNCSSWLGCPEEGALRVRGGEDRCSGRVELWHAGSWGTVCDDGWDLADAEVVCRQLGCGRAVAALGAAAFGPGSGPVWLDEVGCRGSEASLWGCPAERWGRGDRAHEEDAGVRCWEPGPGPPLPAAPFRTFWVVS

SEQ ID NO: 2961 - protein, 160 aa, synthetic construct
  REGION 1..160: note = SCN1B (Q07699) SP+PP+ECD
MGRLLALVVGAALVSSACGGCVEVDSETEAVYGMTFKILCISCKRRSETNAETFTEWTFRQKGTEEFVKILRYENEVLQLEEDERFEGRVVWNGSRGTKDLQDLSIFITNVTYNHSGDYECHVYRLLFFENYEHNTSVVKKIHIEVVDKANRDMASIVSE

SEQ ID NO: 2962 - protein, 159 aa, synthetic construct
  REGION 1..159: note = SCN2B (O60939) SP+PP+ECD
MHRDAWLPRPAFSLTGLSLFFSLVPPGRSMEVTVPATLNVLNGSDARLPCTFNSCYTVNHKQFSLNWTYQECNNCSEEMFLQFRMKIINLKLERFQDRVEFSGNPSKYDVSVMLRNVQPEDEGIYNCYIMNPPDRHRGHGKIHLQVLMEEPPERDSTVA

SEQ ID NO: 2963 - protein, 159 aa, synthetic construct
  REGION 1..159: note = SCN3B (Q9NY72) SP+PP+ECD
MPAFNRLFPLASLVLIYWVSVCFPVCVEVPSETEAVQGNPMKLRCISCMKREEVEATTVVEWFYRPEGGKDFLIYEYRNGHQEVESPFQGRLQWNGSKDLQDVSITVLNVTLNDSGLYTCNVSREFEFEAHRPFVKTTRLIPLRVTEEAGEDFTSVVSE

SEQ ID NO: 2964 - protein, 162 aa, synthetic construct
  REGION 1..162: note = SCN4B (Q8IWT1) SP+PP+ECD
MPGAGDGGKAPARWLGTGLLGLFLLPVTLSLEVSVGKATDIYAVNGTEILLPCTFSSCFGFEDLHFRWTYNSSDAFKILIEGTVKNEKSDPKVTLKDDDRITLVGSTKEKMNNISIVLRDLEFSDTGKYTCHVKNPKENNLQHHATIFLQVVDRLEEVDNTV

SEQ ID NO: 2965 - protein, 254 aa, synthetic construct
  REGION 1..254: note = SDC1 (P18827) SP+PP+ECD
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHLASTTTATTAQEPATSHPHRDMQPGHHETSTPAGPSQADLHTPHTEDGGPSATERAAEDGASSQLPAAEGSGEQDFTFETSGENTAVVAVEPDRRNQSPVDQGATGASQGLLDRKEVLG

SEQ ID NO: 2966 - protein, 144 aa, synthetic construct
  REGION 1..144: note = SDC2 (P34741) SP+PP+ECD
MRRAWILLTLGLVACVSAESRAELTSDKDMYLDNSSIEEASGVYPIDDDDYASASGSGADEDVESPELTTSRPLPKILLTSAAPKVETTTLNIQNKIPAQTKSPEETDKEKVHLSDSERKMDPAEEDTNVYTEKHSDSLFKRTE

SEQ ID NO: 2967 - protein, 1932 aa, synthetic construct
  REGION 1..1932: note = SDK2 (Q58EX2) SP+PP+ECD
MWGLLIWTLLALHQIRAARAQDDVSPYFKTEPVRTQVHLEGNRLVLTCMAEGSWPLEFKWLHNNRELTKFSLEYRYMITSLDRTHAGFYRCIVRNRMGALLQRQTEVQVAYMGSFEEGEKHQSVSHGEAAVIRAPRIASFPQPQVTWFRDGRKIPPSSRIAITLENTLVILSTVAPDAGRYYVQAVNDKNGDNKTSQPITLTVENVGGPADPIAPTIIIPPKNTSVVAGTSEVTLECVANARPLIKLHIIWKKDGVLLSGGISDHNRRLTIPNPTGSDAGYYECEAVLRSSSVPSVVRGAYLSVLEPPQFVKEPERHITAEMEKVVDIPCQAKGVPPPSITWYKDAAVVEVEKLTRFRQRNDGGLQISGLVPDDTGMFQCFARNAAGEVQTSTYLAVTSIAPNITRGPLDSTVIDGMSVVLACETSGAPRPAITWQKGERILASGSVQLPRFTPLESGSLLISPTHISDAGTYTCLATNSRGVDEASADLVVWARTRITKPPQDQSVIKGTQASMVCGVTHDPRVTIRYIWEKDGATLGTESHPRIRLDRNGSLHISQTWSGDIGTYTCRVISAGGNDSRSAHLRVRQLPHAPEHPVATLSTVERRAINLTWTKPFDGNSPLIRYILEMSENNAPWTVLLASVDPKATSVTVKGLVPARSYQFRLCAVNDVGKGQFSKDTERVSLPEEPPTAPPQNVIASGRTNQSIMIQWQPPPESHQNGILKGYIIRYCLAGLPVGYQFKNITDADVNNLLLEDLIIWTNYEIEVAAYNSAGLGVYSSKVTEWTLQGVPTVPPGNVHAEATNSTTIRFTWNAPSPQFINGINQGYKLIAWEPEQEEEVTMVTARPNFQDSIHVGFVSGLKKFTEYFTSVLCFTTPGDGPRSTPQLVRTHEDVPGPVGHLSFSEILDTSLKVSWQEPGEKNGILTGYRISWEEYNRTNTRVTHYLPNVTLEYRVTGLTALTTYTIEVAAMTSKGQGQVSASTISSGVPPELPGPPTNLGISNIGPRSVTLQFRPGYDGKTSISRWLVEAQVGVVGEGEEWLLIHQLSNEPDARSMEVPDLNPFTCYSFRMRQVNIVGTSPPSQPSRKIQTLQAPPDMAPANVSLRTASETSLWLRWMPLPEMEYNGNPESVGYKIKYSRSDGHGKTLSHVVQDRVERDYTIEDLEEWTEYRVQVQAFNAIGSGPWSQTVVGRTRESVPSSGPTNVSALATTSSSMLVRWSEVPEADRNGLVLGYKVMYKEKDSDTQPRFWLVEGNSSRSAQLTGLGKYVLYEVQVLAFTRIGDGSPSHPPILERTLDDVPGPPMGILFPEVRTTSVRLIWQPPAAPNGIILAYQITHRLNTTTANTATVEVLAPSARQYTATGLKPESVYLFRITAQTRKGWGEAAEALVVTTEKRDRPQPPSRPMVQQEDVRARSVLLSWEPGSDGLSPVRYYTIQTRELPSGRWALHSASVSHNASSFIVDRLKPFTSYKFRVKATNDIGDSEFSEESESLTTLQAAPDEAPTILSVTPHTTTSVLIRWQPPAEDKINGILLGFRIRYRELLYEGLRGFTLRGINNPGATWAELTSMYSMRNLSRPSLTQYELDNLNKHRRYEIRMSVYNAVGEGPSSPPQEVFVGEAVPTAAPRNVVVHGATATQLDVTWEPPPLDSQNGDIQGYKIYFWEAQRGNLTERVKTLFLAENSVKLKNLTGYTAYMVSVAAFNAAGDGPRSTPTQGQTQQAAPSAPSSVKFSELTTTSVNVSWEAPQFPNGILEGYRLVYEPCSPVDGVSKIVTVDVKGNSPLWLKVKDLAEGVTYRFRIRAKTFTYGPEIEANVTTGPGEGAPGPPGVPIIVRYSSAIAIHWSSGDPGKGPITRYVIEARPSDEGLWDILIKDIPKEVSSYTFSMDILKPGVSYDFRVIAVNDYGFGTPSSPSQSVPAQKANPFYEEWWF

SEQ ID NO: 2968 - protein, 145 aa, synthetic construct
  REGION 1..145: note = SECTM1 (Q8WVN6) SP+PP+ECD
MQTCPLAFPGHVSQALGTLLFLAASLSAQNEGWDSPICTEGVVSVSWGENTVMSCNISNAFSHVNIKLRAHGQESAIFNEVAPGYFSRDGWQLQVQGGVAQLVIKGARDSHAGLYMWHLVGHQRNNRQVTLEVSGAEPQSAPDTG

SEQ ID NO: 2969 - protein, 556 aa, synthetic construct
  REGION 1..556: note = SELE (P16581) SP+PP+ECD
MIASQFLSALTLVLLIKESGAWSYNTSTEAMTYDEASAYCQQRYTHLVAIQNKEEIEYLNSILSYSPSYYWIGIRKVNNVWVWVGTQKPLTEEAKNWAPGEPNNRQKDEDCVEIYIKREKDVGMWNDERCSKKKLALCYTAACTNTSCSGHGECVETINNYTCKCDPGFSGLKCEQIVNCTALESPEHGSLVCSHPLGNFSYNSSCSISCDRGYLPSSMETMQCMSSGEWSAPIPACNVVECDAVTNPANGFVECFQNPGSFPWNTTCTFDCEEGFELMGAQSLQCTSSGNWDNEKPTCKAVTCRAVRQPQNGSVRCSHSPAGEFTFKSSCNFTCEEGFMLQGPAQVECTTQGQWTQQIPVCEAFQCTALSNPERGYMNCLPSASGSFRYGSSCEFSCEQGFVLKGSKRLQCGPTGEWDNEKPTCEAVRCDAVHQPPKGLVRCAHSPIGEFTYKSSCAFSCEEGFELHGSTQLECTSQGQWTEEVPSCQVVKCSSLAVPGKINMSCSGEPVFGTVCKFACPEGWTLNGSAARTCGATGHWSGLLPTCEAPTESNIP

SEQ ID NO: 2970 - protein, 332 aa, synthetic construct
  REGION 1..332: note = SELL (P14151) SP+PP+ECD
MIFPWKCQSTQRDLWNIFKLWGWTMLCCDFLAHHGTDCWTYHYSEKPMNWQRARRFCRDNYTDLVAIQNKAEIEYLEKTLPFSRSYYWIGIRKIGGIWTWVGTNKSLTEEAENWGDGEPNNKKNKEDCVEIYIKRNKDAGKWNDDACHKLKAALCYTASCQPWSCSGHGECVEIINNYTCNCDVGYYGPQCQFVIQCEPLEAPELGTMDCTHPLGNFSFSSQCAFSCSEGTNLTGIEETTCGPFGNWSSPEPTCQVIQCEPLSAPDLGIMNCSHPLASFSFTSACTFICSEGTELIGKKKTICESSGIWSNPSPICQKLDKSFSMIKEGDYN

SEQ ID NO: 2971 - protein, 771 aa, synthetic construct
  REGION 1..771: note = SELP (P16109) SP+PP+ECD
MANCQIAILYQRFQRVVFGISQLLCFSALISELTNQKEVAAWTYHYSTKAYSWNISRKYCQNRYTDLVAIQNKNEIDYLNKVLPYYSSYYWIGIRKNNKTWTWVGTKKALTNEAENWADNEPNNKRNNEDCVEIYIKSPSAPGKWNDEHCLKKKHALCYTASCQDMSCSKQGECLETIGNYTCSCYPGFYGPECEYVRECGELELPQHVLMNCSHPLGNFSFNSQCSFHCTDGYQVNGPSKLECLASGIWTNKPPQCLAAQCPPLKIPERGNMTCLHSAKAFQHQSSCSFSCEEGFALVGPEVVQCTASGVWTAPAPVCKAVQCQHLEAPSEGTMDCVHPLTAFAYGSSCKFECQPGYRVRGLDMLRCIDSGHWSAPLPTCEAISCEPLESPVHGSMDCSPSLRAFQYDTNCSFRCAEGFMLRGADIVRCDNLGQWTAPAPVCQALQCQDLPVPNEARVNCSHPFGAFRYQSVCSFTCNEGLLLVGASVLQCLATGNWNSVPPECQAIPCTPLLSPQNGTMTCVQPLGSSSYKSTCQFICDEGYSLSGPERLDCTRSGRWTDSPPMCEAIKCPELFAPEQGSLDCSDTRGEFNVGSTCHFSCDNGFKLEGPNNVECTTSGRWSATPPTCKGIASLPTPGLQCPALTTPGQGTMYCRHHPGTFGFNTTCYFGCNAGFTLIGDSTLSCRPSGQWTAVTPACRAVKCSELHVNKPIAMNCSNLWGNFSYGSICSFHCLEGQLLNGSAQTACQENGHWSTTVPTCQAGPLTIQEA

SEQ ID NO: 2972 - protein, 320 aa, synthetic construct
  REGION 1..320: note = SELPLG (Q14242) SP+PP+ECD
MPLQLLLLLILLGPGNSLQLWDTWADEAEKALGPLLARDRRQATEYEYLDYDFLPETEPPEMLRNSTDTTPLTGPGTPESTTVEPAARRSTGLDAGGAVTELTTELANMGNLSTDSAAMEIQTTQPAATEAQTTQPVPTEAQTTPLAATEAQTTRLTATEAQTTPLAATEAQTTPPAATEAQTTQPTGLEAQTTAPAAMEAQTTAPAAMEAQTTPPAAMEAQTTQTTAMEAQTTAPEATEAQTTQPTATEAQTTPLAAMEALSTEPSATEALSMEPTTKRGLFIPFSVSSVTHKGIPMAASNLSVNYPVGAPDHISVKQC

SEQ ID NO: 2973 - protein, 683 aa, synthetic construct
  REGION 1..683: note = SEMA4A (Q9H3S1) SP+PP+ECD
MALPALGLDPWSLLGLFLFQLLQLLLPTTTAGGGGQGPMPRVRYYAGDERRALSFFHQKGLQDFDTLLLSGDGNTLYVGAREAILALDIQDPGVPRLKNMIPWPASDRKKSECAFKKKSNETQCFNFIRVLVSYNVTHLYTCGTFAFSPACTFIELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPHIYAVFTSQWQVGGTRSSAVCAFSLLDIERVFKGKYKELNKETSRWTTYRGPETNPRPGSCSVGPSSDKALTFMKDHFLMDEQVVGTPLLVKSGVEYTRLAVETAQGLDGHSHLVMYLGTTTGSLHKAVVSGDSSAHLVEEIQLFPDPEPVRNLQLAPTQGAVFVGFSGGVWRVPRANCSVYESCVDCVLARDPHCAWDPESRTCCLLSAPNLNSWKQDMERGNPEWACASGPMSRSLRPQSRPQIIKEVLAVPNSILELPCPHLSALASYYWSHGPAAVPEASSTVYNGSLLLIVQDGVGGLYQCWATENGFSYPVISYWVDSQDQTLALDPELAGIPREHVKVPLTRVSGGAALAAQQSYWPH

SEQ ID NO: 2974 - protein, 717 aa, synthetic construct
  REGION 1..717: note = SEMA4B (Q9NPR2) SP+PP+ECD
MLRTAMGLRSWLAAPWGALPPRPPLLLLLLLLLLLQPPPPTWALSPRISLPLGSEERPFLRFEAEHISNYTALLLSRDGRTLYVGAREALFALSSNLSFLPGGEYQELLWGADAEKKQQCSFKGKDPQRDCQNYIKILLPLSGSHLFTCGTAAFSPMCTYINMENFTLARDEKGNVLLEDGKGRCPFDPNFKSTALVVDGELYTGTVSSFQGNDPAISRSQSLRPTKTESSLNWLQDPAFVASAYIPESLGSLQGDDDKIYFFFSETGQEFEFFENTIVSRIARICKGDEGGERVLQQRWTSFLKAQLLCSRPDDGFPFNVLQDVFTLSPSPQDWRDTLFYGVFTSQWHRGTTEGSAVCVFTMKDVQRVFSGLYKEVNRETQQWYTVTHPVPTPRPGACITNSARERKINSSLQLPDRVLNFLKDHFLMDGQVRSRMLLLQPQARYQRVAVHRVPGLHHTYDVLFLGTGDGRLHKAVSVGPRVHIIEELQIFSSGQPVQNLLLDTHRGLLYAASHSGVVQVPMANCSLYRSCGDCLLARDPYCAWSGSSCKHVSLYQPQLATRPWIQDIEGASAKDLCSASSVVSPSFVPTGEKPCEQVQFQPNTVNTLACPLLSNLATRLWLRNGAPVNASASCHVLPTGDLLLVGTQQLGEFQCWSLEEGFQQLVASYCPEVVEDGVADQTDEGGSVPVIISTSRVSAPAGGKASWGADRSYWKE

SEQ ID NO: 2975 - protein, 663 aa, synthetic construct
  REGION 1..663: note = SEMA4C (Q9C0C4) SP+PP+ECD
MAPHWAVWLLAARLWGLGIGAEVWWNLVPRKTVSSGELATVVRRFSQTGIQDFLTLTLTEPTGLLYVGAREALFAFSMEALELQGAISWEAPVEKKTECIQKGKNNQTECFNFIRFLQPYNASHLYVCGTYAFQPKCTYVNMLTFTLEHGEFEDGKGKCPYDPAKGHAGLLVDGELYSATLNNFLGTEPIILRNMGPHHSMKTEYLAFWLNEPHFVGSAYVPESVGSFTGDDDKVYFFFRERAVESDCYAEQVVARVARVCKGDMGGARTLQRKWTTFLKARLACSAPNWQLYFNQLQAMHTLQDTSWHNTTFFGVFQAQWGDMYLSAICEYQLEEIQRVFEGPYKEYHEEAQKWDRYTDPVPSPRPGSCINNWHRRHGYTSSLELPDNILNFVKKHPLMEEQVGPRWSRPLLVKKGTNFTHLVADRVTGLDGATYTVLFIGTGDGWLLKAVSLGPWVHLIEELQLFDQEPMRSLVLSQSKKLLFAGSRSQLVQLPVADCMKYRSCADCVLARDPYCAWSVNTSRCVAVGGHSGSLLIQHVMTSDTSGICNLRGSKKVRPTPKNITVVAGTDLVLPCHLSSNLAHARWTFGGRDLPAEQPGSFLYDARLQALVVMAAQPRHAGAYHCFSEEQGARLAAEGYLVAVVAGPSVTLEARAPLENLG

SEQ ID NO: 2976 - protein, 734 aa, synthetic construct
  REGION 1..734: note = SEMA4D (Q92854) SP+PP+ECD
MRMCTPIRGLLMALAVMFGTAMAFAPIPRITWEHREVHLVQFHEPDIYNYSALLLSEDKDTLYIGAREAVFAVNALNISEKQHEVYWKVSEDKKAKCAEKGKSKQTECLNYIRVLQPLSATSLYVCGTNAFQPACDHLNLTSFKFLGKNEDGKGRCPFDPAHSYTSVMVDGELYSGTSYNFLGSEPIISRNSSHSPLRTEYAIPWLNEPSFVFADVIRKSPDSPDGEDDRVYFFFTEVSVEYEFVFRVLIPRIARVCKGDQGGLRTLQKKWTSFLKARLICSRPDSGLVFNVLRDVFVLRSPGLKVPVFYALFTPQLNNVGLSAVCAYNLSTAEEVFSHGKYMQSTTVEQSHTKWVRYNGPVPKPRPGACIDSEARAANYTSSLNLPDKTLQFVKDHPLMDDSVTPIDNRPRLIKKDVNYTQIVVDRTQALDGTVYDVMFVSTDRGALHKAISLEHAVHIIEETQLFQDFEPVQTLLLSSKKGNRFVYAGSNSGVVQAPLAFCGKHGTCEDCVLARDPYCAWSPPTATCVALHQTESPSRGLIQEMSGDASVCPDKSKGSYRQHFFKHGGTAELKCSQKSNLARVFWKFQNGVLKAESPKYGLMGRKNLLIFNLSEGDSGVYQCLSEERVKNKTVFQVVAKHVLEVKVVPKPVVAPTLSVVQTEGSRIATKVLVASTQGSSPPTPAVQATSSGAITLPPKPAPTGTSCEPKIVINTVPQLHSEKTMYLKSSDNR

SEQ ID NO: 2977 - protein, 659 aa, synthetic construct
  REGION 1..659: note = SEMA4F (O95754) SP+PP+ECD
MPASAARPRPGPGQPTASPFPLLLLAVLSGPVSGRVPRSVPRTSLPISEADSCLTRFAVPHTYNYSVLLVDPASHTLYVGARDTIFALSLPFSGERPRRIDWMVPEAHRQNCRKKGKKEDECHNFVQILAIANASHLLTCGTFAFDPKCGVIDVSRFQQVERLESGRGKCPFEPAQRSAAVMAGGVLYAATVKNYLGTEPIITRAVGRAEDWIRTDTLPSWLNAPAFVAAVALSPAEWGDEDGDDEIYFFFTETSRAFDSYERIKVPRVARVCAGDLGGRKTLQQRWTTFLKADLLCPGPEHGRASSVLQDVAVLRPELGAGTPIFYGIFSSQWEGATISAVCAFRPQDIRTVLNGPFRELKHDCNRGLPVVDNDVPQPRPGECITNNMKLRHFGSSLSLPDRVLTFIRDHPLMDRPVFPADGHPLLVTTDTAYLRVVAHRVTSLSGKEYDVLYLGTEDGHLHRAVRIGAQLSVLEDLALFPEPQPVENMKLYHSWLLVGSRTEVTQVNTTNCGRLQSCSECILAQDPVCAWSFRLDECVAHAGEHRGLVQDIESADVSSLCPKEPGERPVVFEVPVATAAHVVLPCSPSSAWASCVWHQPSGVTALTPRRDGLEVVVTPGAMGAYACECQEGGAAHVVAAYSLVWGSQRDAPSRAHTV

SEQ ID NO: 2978 - protein, 675 aa, synthetic construct
  REGION 1..675: note = SEMA4G (Q9NTN9) SP+PP+ECD
MWGRLWPLLLSILTATAVPGPSLRRPSRELDATPRMTIPYEELSGTRHFKGQAQNYSTLLLEEASARLLVGARGALFSLSANDIGDGAHKEIHWEASPEMQSKCHQKGKNNQTECFNHVRFLQRLNSTHLYACGTHAFQPLCAAIDAEAFTLPTSFEEGKEKCPYDPARGFTGLIIDGGLYTATRYEFRSIPDIRRSRHPHSLRTEETPMHWLNDAEFVFSVLVRESKASAVGDDDKVYYFFTERATEEGSGSFTQSRSSHRVARVARVCKGDLGGKKILQKKWTSFLKARLICHIPLYETLRGVCSLDAETSSRTHFYAAFTLSTQWKTLEASAICRYDLAEIQAVFAGPYMEYQDGSRRWGRYEGGVPEPRPGSCITDSLRSQGYNSSQDLPSLVLDFVKLHPLMARPVVPTRGRPLLLKRNIRYTHLTGTPVTTPAGPTYDLLFLGTADGWIHKAVVLGSGMHIIEETQVFRESQSVENLVISLLQHSLYVGAPSGVIQLPLSSCSRYRSCYDCILARDPYCGWDPGTHACAAATTIANRTALIQDIERGNRGCESSRDTGPPPPLKTRSVLRGDDVLLPCDQPSNLARALWLLNGSMGLSDGQGGYRVGVDGLLVTDAQPEHSGNYGCYAEENGLRTLLASYSLTVRPATPAPAPKAPATPGAQLAPDVRL

SEQ ID NO: 2979 - protein, 968 aa, synthetic construct
  REGION 1..968: note = SEMA5A (Q13591) SP+PP+ECD
MKGTCVIAWLFSSLGLWRLAHPEAQGTTQCQRTEHPVISYKEIGPWLREFRAKNAVDFSQLTFDPGQKELVVGARNYLFRLQLEDLSLIQAVEWECDEATKKACYSKGKSKEECQNYIRVLLVGGDRLFTCGTNAFTPVCTNRSLSNLTEIHDQISGMARCPYSPQHNSTALLTAGGELYAATAMDFPGRDPAIYRSLGILPPLRTAQYNSKWLNEPNFVSSYDIGNFTYFFFRENAVEHDCGKTVFSRAARVCKNDIGGRFLLEDTWTTFMKARLNCSRPGEVPFYYNELQSTFFLPELDLIYGIFTTNVNSIAASAVCVFNLSAIAQAFSGPFKYQENSRSAWLPYPNPNPHFQCGTVDQGLYVNLTERNLQDAQKFILMHEVVQPVTTVPSFMEDNSRFSHVAVDVVQGREALVHIIYLATDYGTIKKVRVPLNQTSSSCLLEEIELFPERRREPIRSLQILHSQSVLFVGLREHVVKIPLKRCQFYRTRSTCIGAQDPYCGWDVVMKKCTSLEESLSMTQWEQSISACPTRNLTVDGHFGVWSPWTPCTHTDGSAVGSCLCRTRSCDSPAPQCGGWQCEGPGMEIANCSRNGGWTPWTSWSPCSTTCGIGFQVRQRSCSNPTPRHGGRVCVGQNREERYCNEHLLCPPHMFWTGWGPWERCTAQCGGGIQARRRICENGPDCAGCNVEYQSCNTNPCPELKKTTPWTPWTPVNISDNGGHYEQRFRYTCKARLADPNLLEVGRQRIEMRYCSSDGTSGCSTDGLSGDFLRAGRYSAHTVNGAWSAWTSWSQCSRDCSRGIRNRKRVCNNPEPKYGGMPCLGPSLEYQECNILPCPVDGVWSCWSPWTKCSATCGGGHYMRTRSCSNPAPAYGGDICLGLHTEEALCNTQPCPESWSEWSDWSECEASGVQVRARQCILLFPMGSQCSGNTTESRPCVFDSNFIPEVSVARSSSVEEKRCGEFNM

SEQ ID NO: 2980 - protein, 649 aa, synthetic construct
  REGION 1..649: note = SEMA6A (Q9H2E6) SP+PP+ECD
MRSEALLLYFTLLHFAGAGFPEDSEPISISHGNYTKQYPVFVGHKPGRNTTQRHRLDIQMIMIMNGTLYIAARDHIYTVDIDTSHTEEIYCSKKLTWKSRQADVDTCRMKGKHKDECHNFIKVLLKKNDDALFVCGTNAFNPSCRNYKMDTLEPFGDEFSGMARCPYDAKHANVALFADGKLYSATVTDFLAIDAVIYRSLGESPTLRTVKHDSKWLKEPYFVQAVDYGDYIYFFFREIAVEYNTMGKVVFPRVAQVCKNDMGGSQRVLEKQWTSFLKARLNCSVPGDSHFYFNILQAVTDVIRINGRDVVLATFSTPYNSIPGSAVCAYDMLDIASVFTGRFKEQKSPDSTWTPVPDERVPKPRPGCCAGSSSLERYATSNEFPDDTLNFIKTHPLMDEAVPSIFNRPWFLRTMVRYRLTKIAVDTAAGPYQNHTVVFLGSEKGIILKFLARIGNSGFLNDSLFLEEMSVYNSEKCSYDGVEDKRIMGMQLDRASSSLYVAFSTCVIKVPLGRCERYGKCKKTCIASRDPYCGWIKEGGACSHLSPNSRLTFEQDIERGNTDGLGDCHNSFVALNGHSSSLLPSTTTSDSTAQEGYESRGGMLDWKHLLDSPDSTDPLGAVSSHNHQDKKGVIRESYLKGHDQLVPVT

SEQ ID NO: 2981 - protein, 603 aa, synthetic construct
  REGION 1..603: note = SEMA6B (Q9H3T3) SP+PP+ECD
MQTPRASPPRPALLLLLLLLGGAHGLFPEEPPPLSVAPRDYLNHYPVFVGSGPGRLTPAEGADDLNIQRVLRVNRTLFIGDRDNLYRVELEPPTSTELRYQRKLTWRSNPSDINVCRMKGKQEGECRNFVKVLLLRDESTLFVCGSNAFNPVCANYSIDTLQPVGDNISGMARCPYDPKHANVALFSDGMLFTATVTDFLAIDAVIYRSLGDRPTLRTVKHDSKWFKEPYFVHAVEWGSHVYFFFREIAMEFNYLEKVVVSRVARVCKNDVGGSPRVLEKQWTSFLKARLNCSVPGDSHFYFNVLQAVTGVVSLGGRPVVLAVFSTPSNSIPGSAVCAFDLTQVAAVFEGRFREQKSPESIWTPVPEDQVPRPRPGCCAAPGMQYNASSALPDDILNFVKTHPLMDEAVPSLGHAPWILRTLMRHQLTRVAVDVGAGPWGNQTVVFLGSEAGTVLKFLVRPNASTSGTSGLSVFLEEFETYRPDRCGRPGGGETGQRLLSLELDAASGGLLAAFPRCVVRVPVARCQQYSGCMKNCIGSQDPYCGWAPDGSCIFLSPGTRAAFEQDVSGASTSGLGDCTGLLRASLSEDRAGLVSVNLLVTSS

SEQ ID NO: 2982 - protein, 604 aa, synthetic construct
  REGION 1..604: note = SEMA6C (Q9H3T2) SP+PP+ECD
MPRAPHFMPLLLLLLLLSLPHTQAAFPQDPLPLLISDLQGTSPLSWFRGLEDDAVAAELGLDFQRFLTLNRTLLVAARDHVFSFDLQAEEEGEGLVPNKYLTWRSQDVENCAVRGKLTDECYNYIRVLVPWDSQTLLACGTNSFSPVCRSYGITSLQQEGEELSGQARCPFDATQSNVAIFAEGSLYSATAADFQASDAVVYRSLGPQPPLRSAKYDSKWLREPHFVQALEHGDHVYFFFREVSVEDARLGRVQFSRVARVCKRDMGGSPRALDRHWTSFLKLRLNCSVPGDSTFYFDVLQALTGPVNLHGRSALFGVFTTQTNSIPGSAVCAFYLDEIERGFEGKFKEQRSLDGAWTPVSEDRVPSPRPGSCAGVGGAALFSSSRDLPDDVLTFIKAHPLLDPAVPPVTHQPLLTLTSRALLTQVAVDGMAGPHSNITVMFLGSNDGTVLKVLTPGGRSGGPEPILLEEIDAYSPARCSGKRTAQTARRIIGLELDTEGHRLFVAFSGCIVYLPLSRCARHGACQRSCLASQDPYCGWHSSRGCVDIRGSGGTDVDQAGNQESMEHGDCQDGATGSQSGPGDSAYGVRRDLPPASASRSVPIP

SEQ ID NO: 2983 - protein, 662 aa, synthetic construct
  REGION 1..662: note = SEMA6D (Q8NFY4) SP+PP+ECD
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLAEGYEQDTEFGNTAHLGDCHEILPTSTTPDYKIFGGPTSDMEVSSSSVTTMASIPEITPKVIDTWRPKLTSSRKFVVQDDPNTSDFTDPLSGIPKGVRWEVQSGESNQMVHMN

SEQ ID NO: 2984 - protein, 925 aa, synthetic construct
  REGION 1..925: note = SEZ6 (Q53EL9) SP+PP+ECD
MRPVALLLLPSLLALLAHGLSLEAPTVGKGQAPGIEETDGELTAAPTPEQPERGVHFVTTAPTLKLLNHHPLLEEFLQEGLEKGDEELRPALPFQPDPPAPFTPSPLPRLANQDSRPVFTSPTPAMAAVPTQPQSKEGPWSPESESPMLRITAPLPPGPSMAVPTLGPGEIASTTPPSRAWTPTQEGPGDMGRPWVAEVVSQGAGIGIQGTITSSTASGDDEETTTTTTIITTTITTVQTPGPCSWNFSGPEGSLDSPTDLSSPTDVGLDCFFYISVYPGYGVEIKVQNISLREGETVTVEGLGGPDPLPLANQSFLLRGQVIRSPTHQAALRFQSLPPPAGPGTFHFHYQAYLLSCHFPRRPAYGDVTVTSLHPGGSARFHCATGYQLKGARHLTCLNATQPFWDSKEPVCIAACGGVIRNATTGRIVSPGFPGNYSNNLTCHWLLEAPEGQRLHLHFEKVSLAEDDDRLIIRNGDNVEAPPVYDSYEVEYLPIEGLLSSGKHFFVELSTDSSGAAAGMALRYEAFQQGHCYEPFVKYGNFSSSTPTYPVGTTVEFSCDPGYTLEQGSIIIECVDPHDPQWNETEPACRAVCSGEITDSAGVVLSPNWPEPYGRGQDCIWGVHVEEDKRIMLDIRVLRIGPGDVLTFYDGDDLTARVLGQYSGPRSHFKLFTSMADVTIQFQSDPGTSVLGYQQGFVIHFFEVPRNDTCPELPEIPNGWKSPSQPELVHGTVVTYQCYPGYQVVGSSVLMCQWDLTWSEDLPSCQRVTSCHDPGDVEHSRRLISSPKFPVGATVQYICDQGFVLMGSSILTCHDRQAGSPKWSDRAPKCLLEQLKPCHGLSAPENGARSPEKQLHPAGATIHFSCAPGYVLKGQASIKCVPGHPSHWSDPPPICRAASLDGFYNSRSLDVAKAPAASSTLDAAH

SEQ ID NO: 2985 - protein, 844 aa, synthetic construct
  REGION 1..844: note = SEZ6L2 (Q6UXD5) SP+PP+ECD
MGTPRAQHPPPPQLLFLILLSCPWIQGLPLKEEEILPEPGSETPTVASEALAELLHGALLRRGPEMGYLPGSDRDPTLATPPAGQTLAVPSLPRATEPGTGPLTTAVTPNGVRGAGPTAPELLTPPPGTTAPPPPSPASPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVTQTTDPSRQLEGGN

SEQ ID NO: 2986 - protein, 290 aa, synthetic construct
  REGION 1..290: note = SGCA (Q16586) SP+PP+ECD
MAETLFWTPLLVVLLAGLGDTEAQQTTLHPLVGRVFVHTLDHETFLSLPEHVAVPPAVHITYHAHLQGHPDLPRWLRYTQRSPHHPGFLYGSATPEDRGLQVIEVTAYNRDSFDTTRQRLVLEIGDPEGPLLPYQAEFLVRSHDAEEVLPSTPASRFLSALGGLWEPGELQLLNVTSALDRGGRVPLPIEGRKEGVYIKVGSASPFSTCLKMVASPDSHARCAQGQPPLLSCYDTLAPHFRVDWCNVTLVDKSVPEPADEVPTPGDGILEHDPFFCPPTEAPDRDFLVDA

SEQ ID NO: 2987 - protein, 87 aa, synthetic construct
  REGION 1..87: note = SHISA4 (Q96DD7) SP+PP+ECD
MPPAGLRRAAPLTAIALLVLGAPLVLAGEDCLWYLDRNGSWHPGFNCEFFTFCCGTCYHRYCCRDLTLLITERQQKHCLAFSPKTIA

SEQ ID NO: 2988 - protein, 174 aa, synthetic construct
  REGION 1..174: note = SHISA6 (Q6ZSJ9) SP+PP+ECD
MALRRLLLLLLLSLESLDLLPSVHGARGRAANRTLSAGGAAVGGRRAGGALARGGRELNGTARAPGIPEAGSRRGQPAAAVAAAASAAVTYETCWGYYDVSGQYDKEFECNNSESGYLYCCGTCYYRFCCKKRHEKLDQRQCTNYQSPVWVQTPSTKVVSPGPENKYDPEKDKT

SEQ ID NO: 2989 - protein, 186 aa, synthetic construct
  REGION 1..186: note = SHISA7 (A6NL88) SP+PP+ECD
MPALLLLVLLASSAGQARARPSNATSAEPAGPLPALLAHLRRLTGALTGGGGAASPGANGTRTGPAGGAGAAARAPPPAELCHGYYDVMGQYDATFNCSTGSYRFCCGTCHYRFCCEHRHMRLAQASCSNYDTPRWATTPPPLAGGAGGAGGAGGGPGPGQAGWLEGGRTGGAGGRGGEGPGGSTA

SEQ ID NO: 2990 - protein, 138 aa, synthetic construct
  REGION 1..138: note = SHISA8 (B8ZZ34) SP+PP+ECD
MARAGARGLLGGRRPPGLRLALALRLALLLARPPSGRAGAPEAQGPAAPGTTAPEGGDRCRGYYDVMGQWDPPFNCSSGAYSFCCGTCGYRFCCHDGPRRLDQSRCSNYDTPAWVQTGRPPARARDTAAPRDPGRERS

SEQ ID NO: 2991 - protein, 149 aa, synthetic construct
  REGION 1..149: note = SHISA9 (B4DS77) SP+PP+ECD
MRRVLRLLLGCFLTELCARVCRAQERAGHGQLAQLGGVLLLAGGNRSGAASGEASEGAEASDAPPTRAPTPDFCRGYFDVMGQWDPPFNCSSGDFIFCCGTCGFRFCCTFKKRRLNQSTCTNYDTPLWLNTGKPPARKDDPLHDPTKDK

SEQ ID NO: 2992 - protein, 1641 aa, synthetic construct
  REGION 1..1641: note = SIGLEC1 (Q9BZZ2) SP+PP+ECD
MGFLPKLLLLASFFPAGQASWGVSSPQDVQGVKGSCLLIPCIFSFPADVEVPDGITAIWYYDYSGQRQVVSHSADPKLVEARFRGRTEFMGNPEHRVCNLLLKDLQPEDSGSYNFRFEISEVNRWSDVKGTLVTVTEEPRVPTIASPVELLEGTEVDFNCSTPYVCLQEQVRLQWQGQDPARSVTFNSQKFEPTGVGHLETLHMAMSWQDHGRILRCQLSVANHRAQSEIHLQVKYAPKGVKILLSPSGRNILPGELVTLTCQVNSSYPAVSSIKWLKDGVRLQTKTGVLHLPQAAWSDAGVYTCQAENGVGSLVSPPISLHIFMAEVQVSPAGPILENQTVTLVCNTPNEAPSDLRYSWYKNHVLLEDAHSHTLRLHLATRADTGFYFCEVQNVHGSERSGPVSVVVNHPPLTPVLTAFLETQAGLVGILHCSVVSEPLATLVLSHGGHILASTSGDSDHSPRFSGTSGPNSLRLEIRDLEETDSGEYKCSATNSLGNATSTLDFHANAARLLISPAAEVVEGQAVTLSCRSGLSPTPDARFSWYLNGALLHEGPGSSLLLPAASSTDAGSYHCRARDGHSASGPSSPAVLTVLYPPRQPTFTTRLDLDAAGAGAGRRGLLLCRVDSDPPARLQLLHKDRVVATSLPSGGGCSTCGGCSPRMKVTKAPNLLRVEIHNPLLEEEGLYLCEASNALGNASTSATFNGQATVLAIAPSHTLQEGTEANLTCNVSREAAGSPANFSWFRNGVLWAQGPLETVTLLPVARTDAALYACRILTEAGAQLSTPVLLSVLYPPDRPKLSALLDMGQGHMALFICTVDSRPLALLALFHGEHLLATSLGPQVPSHGRFQAKAEANSLKLEVRELGLGDSGSYRCEATNVLGSSNTSLFFQVRGAWVQVSPSPELQEGQAVVLSCQVHTGVPEGTSYRWYRDGQPLQESTSATLRFAAITLTQAGAYHCQAQAPGSATTSLAAPISLHVSYAPRHVTLTTLMDTGPGRLGLLLCRVDSDPPAQLRLLHGDRLVASTLQGVGGPEGSSPRLHVAVAPNTLRLEIHGAMLEDEGVYICEASNTLGQASASADFDAQAVNVQVWPGATVREGQLVNLTCLVWTTHPAQLTYTWYQDGQQRLDAHSIPLPNVTVRDATSYRCGVGPPGRAPRLSRPITLDVLYAPRNLRLTYLLESHGGQLALVLCTVDSRPPAQLALSHAGRLLASSTAASVPNTLRLELRGPQPRDEGFYSCSARSPLGQANTSLELRLEGVRVILAPEAAVPEGAPITVTCADPAAHAPTLYTWYHNGRWLQEGPAASLSFLVATRAHAGAYSCQAQDAQGTRSSRPAALQVLYAPQDAVLSSFRDSRARSMAVIQCTVDSEPPAELALSHDGKVLATSSGVHSLASGTGHVQVARNALRLQVQDVPAGDDTYVCTAQNLLGSISTIGRLQVEGARVVAEPGLDVPEGAALNLSCRLLGGPGPVGNSTFAWFWNDRRLHAEPVPTLAFTHVARAQAGMYHCLAELPTGAAASAPVMLRVLYPPKTPTMMVFVEPEGGLRGILDCRVDSEPLASLTLHLGSRLVASSQPQGAPAEPHIHVLASPNALRVDIEALRPSDQGEYICSASNVLGSASTSTYFGVRALHRLHQFQQ

SEQ ID NO: 2993 - protein, 550 aa, synthetic construct
  REGION 1..550: note = SIGLEC10 (Q96LC7) SP+PP+ECD
MLLPLLLSSLLGGSQAMDGRFWIRVQESVMVPEGLCISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTALTQKPDVYIPETLEPGQPVTVICVFNWAFEECPPPSFSWTGAALSSQGTKPTTSHFSVLSFTPRPQDHNTDLTCHVDFSRKGVSAQRTVRLRVAYAPRDLVISISRDNTPALEPQPQGNVPYLEAQKGQFLRLLCAADSQPPATLSWVLQNRVLSSSHPWGPRPLGLELPGVKAGDSGRYTCRAENRLGSQQRALDLSVQYPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYSPKLLGPSCSWEAEGLHCSCSSQASPAPSLRWWLGEELLEGNSSQDSFEVTPSSAGPWANSSLSLHGGLSSGLRLRCEAWNVHGAQSGSILQLPDKKGLISTAFSN

SEQ ID NO: 2994 - protein, 561 aa, synthetic construct
  REGION 1..561: note = SIGLEC11 (Q96RL6) SP+PP+ECD
MVPGQAQPQSPEMLLLPLLLPVLGAGSLNKDPSYSLQVQRQVPVPEGLCVIVSCNLSYPRDGWDESTAAYGYWFKGRTSPKTGAPVATNNQSREVEMSTRDRFQLTGDPGKGSCSLVIRDAQREDEAWYFFRVERGSRVRHSFLSNAFFLKVTALTKKPDVYIPETLEPGQPVTVICVFNWAFKKCPAPSFSWTGAALSPRRTRPSTSHFSVLSFTPSPQDHDTDLTCHVDFSRKGVSAQRTVRLRVAYAPKDLIISISHDNTSALELQGNVIYLEVQKGQFLRLLCAADSQPPATLSWVLQDRVLSSSHPWGPRTLGLELRGVRAGDSGRYTCRAENRLGSQQQALDLSVQYPPENLRVMVSQANRTVLENLGNGTSLPVLEGQSLRLVCVTHSSPPARLSWTRWGQTVGPSQPSDPGVLELPPIQMEHEGEFTCHAQHPLGSQHVSLSLSVHYPPQLLGPSCSWEAEGLHCSCSSQASPAPSLRWWLGEELLEGNSSQGSFEVTPSSAGPWANSSLSLHGGLSSGLRLRCKAWNVHGAQSGSVFQLLPGKLEHGGGLGL

SEQ ID NO: 2995 - protein, 481 aa, synthetic construct
  REGION 1..481: note = SIGLEC12 (Q96PQ1) SP+PP+ECD
MLLLLLLLPPLLCGRVGAKEQKDYLLTMQKSVTVQEGLCVSVLCSFSYPQNGWTASDPVHGYWFRAGDHVSRNIPVATNNPARAVQEETRDRFHLLGDPQNKDCTLSIRDTRESDAGTYVFCVERGNMKWNYKYDQLSVNVTASQDLLSRYRLEVPESVTVQEGLCVSVPCSVLYPHYNWTASSPVYGSWFKEGADIPWDIPVATNTPSGKVQEDTHGRFLLLGDPQTNNCSLSIRDARKGDSGKYYFQVERGSRKWNYIYDKLSVHVTALTHMPTFSIPGTLESGHPRNLTCSVPWACEQGTPPTITWMGASVSSLDPTITRSSMLSLIPQPQDHGTSLTCQVTLPGAGVTMTRAVRLNISYPPQNLTMTVFQGDGTASTTLRNGSALSVLEGQSLHLVCAVDSNPPARLSWTWGSLTLSPSQSSNLGVLELPRVHVKDEGEFTCRAQNPLGSQHISLSLSLQNEYTGKMRPISGVTLGA

SEQ ID NO: 2996 - protein, 358 aa, synthetic construct
  REGION 1..358: note = SIGLEC14 (Q08ET2) SP+PP+ECD
MLPLLLLPLLWGGSLQEKPVYELQVQKSVTVQEGLCVLVPCSFSYPWRSWYSSPPLYVYWFRDGEIPYYAEVVATNNPDRRVKPETQGRFRLLGDVQKKNCSLSIGDARMEDTGSYFFRVERGRDVKYSYQQNKLNLEVTALIEKPDIHFLEPLESGRPTRLSCSLPGSCEAGPPLTFSWTGNALSPLDPETTRSSELTLTPRPEDHGTNLTCQVKRQGAQVTTERTVQLNVSYAPQNLAISIFFRNGTGTALRILSNGMSVPIQEGQSLFLACTVDSNPPASLSWFREGKALNPSQTSMSGTLELPNIGAREGGEFTCRVQHPLGSQHLSFILSVQRSSSSCICVTEKQQGSWPLVL

SEQ ID NO: 2997 - protein, 263 aa, synthetic construct
  REGION 1..263: note = SIGLEC15 (Q6ZMC9) SP+PP+ECD
MEKSIWLLACLAWVLPTGSFVRTKIDTTENLLNTEVHSSPAQRWSMQVPPEVSAEAGDAAVLPCTFTHPHRHYDGPLTAIWRAGEPYAGPQVFRCAAARGSELCQTALSLHGRFRLLGNPRRNDLSLRVERLALADDRRYFCRVEFAGDVHDRYESRHGVRLHVTAAPRIVNISVLPSPAHAFRALCTAEGEPPPALAWSGPALGNSLAAVRSPREGHGHLVTAELPALTHDGRYTCTAANSLGRSEASVYLFRFHGASGAST

SEQ ID NO: 2998 - protein, 434 aa, synthetic construct
  REGION 1..434: note = SIGLEC16 (A6NMB1) SP+PP+ECD
MLLLPLLLPVLGAGSLNKDPSYSLQVQRQVPVPEGLCVIVSCNLSYPRDGWDESTAAYGYWFKGRTSPKTGAPVATNNQSREVAMSTRDRFQLTGDPGKGSCSLVIRDAQREDEAWYFFRVERGSRVRHSFLSNAFFLKVTALTQKPDVYIPETLEPGQPVTVICVFNWAFKKCPAPSFSWTGAALSPRRTRPSTSHFSVLSFTPSPQDHDTDLTCHVDFSRKGVSAQRTVRLRVASLELQGNVIYLEVQKGQFLRLLCAADSQPPATLSWVLQDRVLSSSHPWGPRTLGLELPGVKAGDSGRYTCRAENRLGSQQRALDLSVQYPPENLRVMVSQANRTVLENLRNGTSLRVLEGQSLRLVCVTHSSPPARLSWTWGEQTVGPSQPSDPGVLQLPRVQMEHEGEFTCHARHPLGSQRVSLSFSVHCKSGPMTG

SEQ ID NO: 2999 - protein, 441 aa, synthetic construct
  REGION 1..441: note = SIGLEC5 (O15389) SP+PP+ECD
MLPLLLLPLLWGGSLQEKPVYELQVQKSVTVQEGLCVLVPCSFSYPWRSWYSSPPLYVYWFRDGEIPYYAEVVATNNPDRRVKPETQGRFRLLGDVQKKNCSLSIGDARMEDTGSYFFRVERGRDVKYSYQQNKLNLEVTALIEKPDIHFLEPLESGRPTRLSCSLPGSCEAGPPLTFSWTGNALSPLDPETTRSSELTLTPRPEDHGTNLTCQMKRQGAQVTTERTVQLNVSYAPQTITIFRNGIALEILQNTSYLPVLEGQALRLLCDAPSNPPAHLSWFQGSPALNATPISNTGILELRRVRSAEEGGFTCRAQHPLGFLQIFLNLSVYSLPQLLGPSCSWEAEGLHCRCSFRARPAPSLCWRLEEKPLEGNSSQGSFKVNSSSAGPWANSSLILHGGLSSDLKVSCKAWNIYGSQSGSVLLLQGRSNLGTGVVPAAL

SEQ ID NO: 3000 - protein, 347 aa, synthetic construct
  REGION 1..347: note = SIGLEC6 (O43699) SP+PP+ECD
MQGAQEASASEMLPLLLPLLWAGALAQERRFQLEGPESLTVQEGLCVLVPCRLPTTLPASYYGYGYWFLEGADVPVATNDPDEEVQEETRGRFHLLWDPRRKNCSLSIRDARRRDNAAYFFRLKSKWMKYGYTSSKLSVRVMALTHRPNISIPGTLESGHPSNLTCSVPWVCEQGTPPIFSWMSAAPTSLGPRTTQSSVLTITPRPQDHSTNLTCQVTFPGAGVTMERTIQLNVSYAPQKVAISIFQGNSAAFKILQNTSSLPVLEGQALRLLCDADGNPPAHLSWFQGFPALNATPISNTGVLELPQVGSAEEGDFTCRAQHPLGSLQISLSLFVHWKPEGRAGGV

SEQ ID NO: 3001 - protein, 353 aa, synthetic construct
  REGION 1..353: note = SIGLEC7 (Q9Y286) SP+PP+ECD
MLLLLLLPLLWGRERVEGQKSNRKDYSLTMQSSVTVQEGMCVHVRCSFSYPVDSQTDSDPVHGYWFRAGNDISWKAPVATNNPAWAVQEETRDRFHLLGDPQTKNCTLSIRDARMSDAGRYFFRMEKGNIKWNYKYDQLSVNVTALTHRPNILIPGTLESGCFQNLTCSVPWACEQGTPPMISWMGTSVSPLHPSTTRSSVLTLIPQPQHHGTSLTCQVTLPGAGVTTNRTIQLNVSYPPQNLTVTVFQGEGTASTALGNSSSLSVLEGQSLRLVCAVDSNPPARLSWTWRSLTLYPSQPSNPLVLELQVHLGDEGEFTCRAQNSLGSQHVSLNLSLQQEYTGKMRPVSGVLL

SEQ ID NO: 3002 - protein, 363 aa, synthetic construct
  REGION 1..363: note = SIGLEC8 (Q9NYZ4) SP+PP+ECD
MLLLLLLLPLLWGTKGMEGDRQYGDGYLLQVQELVTVQEGLCVHVPCSFSYPQDGWTDSDPVHGYWFRAGDRPYQDAPVATNNPDREVQAETQGRFQLLGDIWSNDCSLSIRDARKRDKGSYFFRLERGSMKWSYKSQLNYKTKQLSVFVTALTHRPDILILGTLESGHSRNLTCSVPWACKQGTPPMISWIGASVSSPGPTTARSSVLTLTPKPQDHGTSLTCQVTLPGTGVTTTSTVRLDVSYPPWNLTMTVFQGDATASTALGNGSSLSVLEGQSLRLVCAVNSNPPARLSWTRGSLTLCPSRSSNPGLLELPRVHVRDEGEFTCRAQNAQGSQHISLSLSLQNEGTGTSRPVSQVTLAA

SEQ ID NO: 3003 - protein, 348 aa, synthetic construct
  REGION 1..348: note = SIGLEC9 (Q9Y336) SP+PP+ECD
MLLLLLPLLWGRERAEGQTSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSLQSKATSGVTQG

SEQ ID NO: 3004 - protein, 373 aa, synthetic construct
  REGION 1..373: note = SIRPA (P78324) SP+PP+ECD
MEPAGPAPGRLGPLLCLLLAASCAWSGVAGEEELQVIQPDKSVLVAAGETATLRCTATSLIPVGPIQWFRGAGPGRELIYNQKEGHFPRVTTVSDLTKRNNMDFSIRIGNITPADAGTYYCVKFRKGSPDDVEFKSGAGTELSVRAKPSAPVVSGPAARATPQHTVSFTCESHGFSPRDITLKWFKNGNELSDFQTNVDPVGESVSYSIHSTAKVVLTREDVHSQVICEVAHVTLQGDPLRGTANLSETIRVPPTLEVTQQPVRAENQVNVTCQVRKFYPQRLQLTWLENGNVSRTETASTVTENKDGTYNWMSWLLVNVSAHRDDVKLTCQVEHDGQPAVSKSHDLKVSAHPKEQGSNTAAENTGSNERNIY

SEQ ID NO: 3005 - protein, 371 aa, synthetic construct
  REGION 1..371: note = SIRPB1 (O00241) SP+PP+ECD
MPVPASWPHLPSPFLLMTLLLGRLTGVAGEDELQVIQPEKSVSVAAGESATLRCAMTSLIPVGPIMWFRGAGAGRELIYNQKEGHFPRVTTVSELTKRNNLDFSISISNITPADAGTYYCVKFRKGSPDDVEFKSGAGTELSVRAKPSAPVVSGPAVRATPEHTVSFTCESHGFSPRDITLKWFKNGNELSDFQTNVDPAGDSVSYSIHSTARVVLTRGDVHSQVICEIAHITLQGDPLRGTANLSEAIRVPPTLEVTQQPMRAENQANVTCQVSNFYPRGLQLTWLENGNVSRTETASTLIENKDGTYNWMSWLLVNTCAHRDDVVLTCQVEHDGQQAVSKSYALEISAHQKEHGSDITHEAALAPTAPL

SEQ ID NO: 3006 - protein, 371 aa, synthetic construct; identical to SEQ ID NO: 3005
  REGION 1..371: note = SIRPB1 (Q5TFQ8) SP+PP+ECD

SEQ ID NO: 3007 - protein, 287 aa, synthetic construct
  REGION 1..287: note = SIRPB2 (Q5JXA9) SP+PP+ECD
MCSTMSAPTCLAHLPPCFLLLALVLVPSDASGQSSRNDWQVLQPEGPMLVAEGETLLLRCMVVGSCTDGMIKWVKVSTQDQQEIYNFKRGSFPGVMPMIQRTSEPLNCDYSIYIHNVTREHTGTYHCVRFDGLSEHSEMKSDEGTSVLVKGAGDPEPDLWIIQPQELVLGTTGDTVFLNCTVLGDGPPGPIRWFQGAGLSREAIYNFGGISHPKETAVQASNNDFSILLQNVSSEDAGTYYCVKFQRKPNRQYLSGQGTSLKVKAKSTSSKEAEFTSEPATEMSPTG

SEQ ID NO: 3008 - protein, 360 aa, synthetic construct
  REGION 1..360: note = SIRPG (Q9P1W8) SP+PP+ECD
MPVPASWPHPPGPFLLLTLLLGLTEVAGEEELQMIQPEKLLLVTVGKTATLHCTVTSLLPVGPVLWFRGVGPGRELIYNQKEGHFPRVTTVSDLTKRNNMDFSIRISSITPADVGTYYCVKFRKGSPENVEFKSGPGTEMALGAKPSAPVVLGPAARTTPEHTVSFTCESHGFSPRDITLKWFKNGNELSDFQTNVDPTGQSVAYSIRSTARVVLDPWDVRSQVICEVAHVTLQGDPLRGTANLSEAIRVPPTLEVTQQPMRVGNQVNVTCQVRKFYPQSLQLTWSENGNVCQRETASTLTENKDGTYNWTSWFLVNISDQRDDVVLTCQVKHDGQLAVSKRLALEVTVHQKDQSSDATP

SEQ ID NO: 3009 - protein, 40 aa, synthetic construct
  REGION 1..40: note = SIT1 (Q9Y3P8) SP+PP+ECD
MNQADPRLRAVCLWTLTSAAMSRGDNCTDLLALGIPSITQ

SEQ ID NO: 3010 - protein, 237 aa, synthetic construct
  REGION 1..237: note = SLAMF1 (Q13291) SP+PP+ECD
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPSETKP

SEQ ID NO: 3011 - protein, 226 aa, synthetic construct
  REGION 1..226: note = SLAMF6 (Q96DU3) SP+PP+ECD
MLWLFQSLLFVFCFGPGNVVSQSSLTPLMVNGILGESVTLPLEFPAGEKVNFITWLFNETSLAFIVPHETKSPEIHVTNPKQGKRLNFTQSYSLQLSNLKMEDTGSYRAQISTKTSAKLSSYTLRILRQLRNIQVTNHSQLFQNMTCELHLTCSVEDADDNVSFRWEALGNTLSSQPNLTVSWDPRISSEQDYTCIAENAVSNLSFSVSAQKLCEDVKIQYTDTKM

SEQ ID NO: 3012 - protein, 226 aa, synthetic construct
  REGION 1..226: note = SLAMF7 (Q9NQ25) SP+PP+ECD
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSM

SEQ ID NO: 3013 - protein, 233 aa, synthetic construct
  REGION 1..233: note = SLAMF8 (Q9P0V8) SP+PP+ECD
MVMRPLWSLLLWEALLPITVTGAQVLSKVGGSVLLVAARPPGFQVREAIWRSLWPSEELLATFFRGSLETLYHSRFLGRAQLHSNLSLELGPLESGDSGNFSVLMVDTRGQPWTQTLQLKVYDAVPRPVVQVFIAVERDAQPSKTCQVFLSCWAPNISEITYSWRRETTMDFGMEPHSLFTDGQVLSISLGPGDRDVAYSCIVSNPVSWDLATVTPWDSCHHEAAPGKASYKD

SEQ ID NO: 3014 - protein, 236 aa, synthetic construct
  REGION 1..236: note = SLAMF9 (Q96A28) SP+PP+ECD
MCAFPWLLLLLLLQEGSQRRLWRWCGSEEVVAVLQESISLPLEIPPDEEVENIIWSSHKSLATVVPGKEGHPATIMVTNPHYQGQVSFLDPSYSLHISNLSWEDSGLYQAQVNLRTSQISTMQQYNICVYRWLSEPQITVNFESSGEGACSMSLVCSVEKAGMDMTYSWLSRGDSTYTFHEGPVLSTSWRPGDSALSYTCRANNPISNVSSCPIPDGPFYADPNYASEKPSTAFCL

SEQ ID NO: 3015 - protein, 622 aa, synthetic construct
  REGION 1..622: note = SLITRK1 (Q96PX8) SP+PP+ECD
MLLWILLLETSLCFAAGNVTGDVCKEKICSCNEIEGDLHVDCEKKGFTSLQRFTAPTSQFYHLFLHGNSLTRLFPNEFANFYNAVSLHMENNGLHEIVPGAFLGLQLVKRLHINNNKIKSFRKQTFLGLDDLEYLQADFNLLRDIDPGAFQDLNKLEVLILNDNLISTLPANVFQYVPITHLDLRGNRLKTLPYEEVLEQIPGIAEILLEDNPWDCTCDLLSLKEWLENIPKNALIGRVVCEAPTRLQGKDLNETTEQDLCPLKNRVDSSLPAPPAQEETFAPGPLPTPFKTNGQEDHATPGSAPNGGTKIPGNWQIKIRPTAAIATGSSRNKPLANSLPCPGGCSCDHIPGSGLKMNCNNRNVSSLADLKPKLSNVQELFLRDNKIHSIRKSHFVDYKNLILLDLGNNNIATVENNTFKNLLDLRWLYMDSNYLDTLSREKFAGLQNLEYLNVEYNAIQLILPGTFNAMPKLRILILNNNLLRSLPVDVFAGVSLSKLSLHNNYFMYLPVAGVLDQLTSIIQIDLHGNPWECSCTIVPFKQWAERLGSEVLMSDLKCETPVNFFRKDFMLLSNDEICPQLYARISPTLTSHSKNSTGLAETGTHSNSYLDTSRVSISVLVP

SEQ ID NO: 3016 - protein, 621 aa, synthetic construct
  REGION 1..621: note = SLITRK2 (Q9H156) SP+PP+ECD
MLSGVWFLSVLTVAGILQTESRKTAKDICKIRCLCEEKENVLNINCENKGFTTVSLLQPPQYRIYQLFLNGNLLTRLYPNEFVNYSNAVTLHLGNNGLQEIRTGAFSGLKTLKRLHLNNNKLEILREDTFLGLESLEYLQADYNYISAIEAGAFSKLNKLKVLILNDNLLLSLPSNVFRFVLLTHLDLRGNRLKVMPFAGVLEHIGGIMEIQLEENPWNCTCDLLPLKAWLDTITVFVGEIVCETPFRLHGKDVTQLTRQDLCPRKSASDSSQRGSHADTHVQRLSPTMNPALNPTRAPKASRPPKMRNRPTPRVTVSKDRQSFGPIMVYQTKSPVPLTCPSSCVCTSQSSDNGLNVNCQERKFTNISDLQPKPTSPKKLYLTGNYLQTVYKNDLLEYSSLDLLHLGNNRIAVIQEGAFTNLTSLRRLYLNGNYLEVLYPSMFDGLQSLQYLYLEYNVIKEIKPLTFDALINLQLLFLNNNLLRSLPDNIFGGTALTRLNLRNNHFSHLPVKGVLDQLPAFIQIDLQENPWDCTCDIMGLKDWTEHANSPVIINEVTCESPAKHAGEILKFLGREAICPDSPNLSDGTVLSMNHNTDTPRSLSVSPSSYPELHTEVPLSVL

SEQ ID NO: 3017 - protein, 618 aa, synthetic construct
  REGION 1..618: note = SLITRK4 (Q8IW52) SP+PP+ECD
MFLWLFLILSALISSTNADSDISVEICNVCSCVSVENVLYVNCEKVSVYRPNQLKPPWSNFYHLNFQNNFLNILYPNTFLNFSHAVSLHLGNNKLQNIEGGAFLGLSALKQLHLNNNELKILRADTFLGIENLEYLQADYNLIKYIERGAFNKLHKLKVLILNDNLISFLPDNIFRFASLTHLDIRGNRIQKLPYIGVLEHIGRVVELQLEDNPWNCSCDLLPLKAWLENMPYNIYIGEAICETPSDLYGRLLKETNKQELCPMGTGSDFDVRILPPSQLENGYTTPNGHTTQTSLHRLVTKPPKTTNPSKISGIVAGKALSNRNLSQIVSYQTRVPPLTPCPAPCFCKTHPSDLGLSVNCQEKNIQSMSELIPKPLNAKKLHVNGNSIKDVDVSDFTDFEGLDLLHLGSNQITVIKGDVFHNLTNLRRLYLNGNQIERLYPEIFSGLHNLQYLYLEYNLIKEISAGTFDSMPNLQLLYLNNNLLKSLPVYIFSGAPLARLNLRNNKFMYLPVSGVLDQLQSLTQIDLEGNPWDCTCDLVALKLWVEKLSDGIVVKELKCETPVQFANIELKSLKNEILCPKLLNKPSAPFTSPAPAITFTTPLGPIRSPPGGPVPLS

SEQ ID NO: 3018 - protein, 664 aa, synthetic construct
  REGION 1..664: note = SLITRK5 (O94991) SP+PP+ECD
MHTCCPPVTLEQDLHRKMHSWMLQTLAFAVTSLVLSCAETIDYYGEICDNACPCEEKDGILTVSCENRGIISLSEISPPRFPIYHLLLSGNLLNRLYPNEFVNYTGASILHLGSNVIQDIETGAFHGLRGLRRLHLNNNKLELLRDDTFLGLENLEYLQVDYNYISVIEPNAFGKLHLLQVLILNDNLLSSLPNNLFRFVPLTHLDLRGNRLKLLPYVGLLQHMDKVVELQLEENPWNCSCELISLKDWLDSISYSALVGDVVCETPFRLHGRDLDEVSKQELCPRRLISDYEMRPQTPLSTTGYLHTTPASVNSVATSSSAVYKPPLKPPKGTRQPNKPRVRPTSRQPSKDLGYSNYGPSIAYQTKSPVPLECPTACSCNLQISDLGLNVNCQERKIESIAELQPKPYNPKKMYLTENYIAVVRRTDFLEATGLDLLHLGNNRISMIQDRAFGDLTNLRRLYLNGNRIERLSPELFYGLQSLQYLFLQYNLIREIQSGTFDPVPNLQLLFLNNNLLQAMPSGVFSGLTLLRLNLRSNHFTSLPVSGVLDQLKSLIQIDLHDNPWDCTCDIVGMKLWVEQLKVGVLVDEVICKAPKKFAETDMRSIKSELLCPDYSDVVVSTPTPSSIQVPARTSAVTPAVRLNSTGAPASLGAGGGASSVPLS

SEQ ID NO: 3019 - protein, 608 aa, synthetic construct
  REGION 1..608: note = SLITRK6 (Q9H5Y7) SP+PP+ECD
MKLWIHLFYSSLLACISLHSQTPVLSSRGSCDSLCNCEEKDGTMLINCEAKGIKMVSEISVPPSRPFQLSLLNNGLTMLHTNDFSGLTNAISIHLGFNNIADIEIGAFNGLGLLKQLHINHNSLEILKEDTFHGLENLEFLQADNNFITVIEPSAFSKLNRLKVLILNDNAIESLPPNIFRFVPLTHLDLRGNQLQTLPYVGFLEHIGRILDLQLEDNKWACNCDLLQLKTWLENMPPQSIIGDVVCNSPPFFKGSILSRLKKESICPTPPVYEEHEDPSGSLHLAATSSINDSRMSTKTTSILKLPTKAPGLIPYITKPSTQLPGPYCPIPCNCKVLSPSGLLIHCQERNIESLSDLRPPPQNPRKLILAGNIIHSLMKSDLVEYFTLEMLHLGNNRIEVLEEGSFMNLTRLQKLYLNGNHLTKLSKGMFLGLHNLEYLYLEYNAIKEILPGTFNPMPKLKVLYLNNNLLQVLPPHIFSGVPLTKVNLKTNQFTHLPVSNILDDLDLLTQIDLEDNPWDCSCDLVGLQQWIQKLSKNTVTDDILCTSPGHLDKKELKALNSEILCPGLVNNPSMPTQTSYLMVTTPATTTNTADTILRSLTDAVPLS

SEQ ID NO: 3020 - protein, 1099 aa, synthetic construct
  REGION 1..1099: note = SORCS1 (Q8WY21) SP+PP+ECD
MGKVGAGGGSQARLSALLAGAGLLILCAPGVCGGGSCCPSPHPSSAPRSASTPRGFSHQGRPGRAPATPLPLVVRPLFSVAPGDRALSLERARGTGASMAVAARSGRRRRSGADQEKAERGEGASRSPRGVLRDGGQQEPGTRERDPDKATRFRMEELRLTSTTFALTGDSAHNQAMVHWSGHNSSVILILTKLYDYNLGSITESSLWRSTDYGTTYEKLNDKVGLKTILSYLYVCPTNKRKIMLLTDPEIESSLLISSDEGATYQKYRLNFYIQSLLFHPKQEDWILAYSQDQKLYSSAEFGRRWQLIQEGVVPNRFYWSVMGSNKEPDLVHLEARTVDGHSHYLTCRMQNCTEANRNQPFPGYIDPDSLIVQDHYVFVQLTSGGRPHYYVSYRRNAFAQMKLPKYALPKDMHVISTDENQVFAAVQEWNQNDTYNLYISDTRGVYFTLALENVQSSRGPEGNIMIDLYEVAGIKGMFLANKKIDNQVKTFITYNKGRDWRLLQAPDTDLRGDPVHCLLPYCSLHLHLKVSENPYTSGIIASKDTAPSIIVASGNIGSELSDTDISMFVSSDAGNTWRQIFEEEHSVLYLDQGGVLVAMKHTSLPIRHLWLSFDEGRSWSKYSFTSIPLFVDGVLGEPGEETLIMTVFGHFSHRSEWQLVKVDYKSIFDRRCAEEDYRPWQLHSQGEACIMGAKRIYKKRKSERKCMQGKYAGAMESEPCVCTEADFDCDYGYERHSNGQCLPAFWFNPSSLSKDCSLGQSYLNSTGYRKVVSNNCTDGVREQYTAKPQKCPGKAPRGLRIVTADGKLTAEQGHNVTLMVQLEEGDVQRTLIQVDFGDGIAVSYVNLSSMEDGIKHVYQNVGIFRVTVQVDNSLGSDSAVLYLHVTCPLEHVHLSLPFVTTKNKEVNATAVLWPSQVGTLTYVWWYGNNTEPLITLEGSISFRFTSEGMNTITVQVSAGNAILQDTKTIAVYEEFRSLRLSFSPNLDDYNPDIPEWRRDIGRVIKKSLVEATGVPGQHILVAVLPGLPTTAELFVLPYQDPAGENKRSTDDLEQISELLIHTLNQNSVHFELKPGVRVLVHAAHLTAAPLVDLTPTHS

SEQ ID NO: 3021 - protein, 1078 aa, synthetic construct
  REGION 1..1078: note = SORCS2 (Q96PQ0) SP+PP+ECD
MAHRGPSRASKGPGPTARAPSPGAPPPPRSPRSRPLLLLLLLLGACGAAGRSPEPGRLGPHAQLTRVPRSPPAGRAEPGGGEDRQARGTEPGAPGPSPGPAPGPGEDGAPAAGYRRWERAAPLAGVASRAQVSLISTSFVLKGDATHNQAMVHWTGENSSVILILTKYYHADMGKVLESSLWRSSDFGTSYTKLTLQPGVTTVIDNFYICPTNKRKVILVSSSLSDRDQSLFLSADEGATFQKQPIPFFVETLIFHPKEEDKVLAYTKESKLYVSSDLGKKWTLLQERVTKDHVFWSVSGVDADPDLVHVEAQDLGGDFRYVTCAIHNCSEKMLTAPFAGPIDHGSLTVQDDYIFFKATSANQTKYYVSYRRNEFVLMKLPKYALPKDLQIISTDESQVFVAVQEWYQMDTYNLYQSDPRGVRYALVLQDVRSSRQAEESVLIDILEVRGVKGVFLANQKIDGKVMTLITYNKGRDWDYLRPPSMDMNGKPTNCKPPDCHLHLHLRWADNPYVSGTVHTKDTAPGLIMGAGNLGSQLVEYKEEMYITSDCGHTWRQVFEEEHHILYLDHGGVIVAIKDTSIPLKILKFSVDEGLTWSTHNFTSTSVFVDGLLSEPGDETLVMTVFGHISFRSDWELVKVDFRPSFSRQCGEEDYSSWELSNLQGDRCIMGQQRSFRKRKSTSWCIKGRSFTSALTSRVCECRDSDFLCDYGFERSSSSESSTNKCSANFWFNPLSPPDDCALGQTYTSSLGYRKVVSNVCEGGVDMQQSQVQLQCPLTPPRGLQVSIQGEAVAVRPGEDVLFVVRQEQGDVLTTKYQVDLGDGFKAMYVNLTLTGEPIRHRYESPGIYRVSVRAENTAGHDEAVLFVQVNSPLQALYLEVVPVIGLNQEVNLTAVLLPLNPNLTVFYWWIGHSLQPLLSLDNSVTTRFSDTGDVRVTVQAACGNSVLQDSRVLRVLDQFQVMPLQFSKELDAYNPNTPEWREDVGLVVTRLLSKETSVPQELLVTVVKPGLPTLADLYVLLPPPRPTRKRSLSSDKRLAAIQQVLNAQKISFLLRGGVRVLVALRDTGTGAEQLGGGG

SEQ ID NO: 3022 - protein, 1125 aa, synthetic construct
  REGION 1..1125: note = SORCS3 (Q9UPU3) SP+PP+ECD
MEAARTERPAGRPGAPLVRTGLLLLSTWVLAGAEITWDATGGPGRPAAPASRPPALSPLSPRAVASQWPEELASARRAAVLGRRAGPELLPQQGGGRGGEMQVEAGGTSPAGERRGRGIPAPAKLGGARRSRRAQPPITQERGDAWATAPADGSRGSRPLAKGSREEVKAPRAGGSAAEDLRLPSTSFALTGDSAHNQAMVHWSGHNSSVILILTKLYDFNLGSVTESSLWRSTDYGTTYEKLNDKVGLKTVLSYLYVNPTNKRKIMLLSDPEMESSILISSDEGATYQKYRLTFYIQSLLFHPKQEDWVLAYSLDQKLYSSMDFGRRWQLMHERITPNRFYWSVAGLDKEADLVHMEVRTTDGYAHYLTCRIQECAETTRSGPFARSIDISSLVVQDEYIFIQVTTSGRASYYVSYRREAFAQIKLPKYSLPKDMHIISTDENQVFAAVQEWNQNDTYNLYISDTRGIYFTLAMENIKSSRGLMGNIIIELYEVAGIKGIFLANKKVDDQVKTYITYNKGRDWRLLQAPDVDLRGSPVHCLLPFCSLHLHLQLSENPYSSGRISSKETAPGLVVATGNIGPELSYTDIGVFISSDGGNTWRQIFDEEYNVWFLDWGGALVAMKHTPLPVRHLWVSFDEGHSWDKYGFTSVPLFVDGALVEAGMETHIMTVFGHFSLRSEWQLVKVDYKSIFSRHCTKEDYQTWHLLNQGEPCVMGERKIFKKRKPGAQCALGRDHSGSVVSEPCVCANWDFECDYGYERHGESQCVPAFWYNPASPSKDCSLGQSYLNSTGYRRIVSNNCTDGLREKYTAKAQMCPGKAPRGLHVVTTDGRLVAEQGHNATFIILMEEGDLQRTNIQLDFGDGIAVSYANFSPIEDGIKHVYKSAGIFQVTAYAENNLGSDTAVLFLHVVCPVEHVHLRVPFVAIRNKEVNISAVVWPSQLGTLTYFWWFGNSTKPLITLDSSISFTFLAEGTDTITVQVAAGNALIQDTKEIAVHEYFQSQLLSFSPNLDYHNPDIPEWRKDIGNVIKRALVKVTSVPEDQILIAVFPGLPTSAELFILPPKNLTERRKGNEGDLEQIVETLFNALNQNLVQFELKPGVQVIVYVTQLTLAPLVDSSAGHSSS

SEQ ID NO: 3023 - protein, 2137 aa, synthetic construct
  REGION 1..2137: note = SORL1 (Q92673) SP+PP+ECD
MATRSSRRESRLPFLFTLVALLPPGALCEVWTQRLHGGSAPLPQDRGFLVVQGDPRELRLWARGDARGASRADEKPLRRKRSAALQPEPIKVYGQVSLNDSHNQMVVHWAGEKSNVIVALARDSLALARPKSSDVYVSYDYGKSFKKISDKLNFGLGNRSEAVIAQFYHSPADNKRYIFADAYAQYLWITFDFCNTLQGFSIPFRAADLLLHSKASNLLLGFDRSHPNKQLWKSDDFGQTWIMIQEHVKSFSWGIDPYDKPNTIYIERHEPSGYSTVFRSTDFFQSRENQEVILEEVRDFQLRDKYMFATKVVHLLGSEQQSSVQLWVSFGRKPMRAAQFVTRHPINEYYIADASEDQVFVCVSHSNNRTNLYISEAEGLKFSLSLENVLYYSPGGAGSDTLVRYFANEPFADFHRVEGLQGVYIATLINGSMNEENMRSVITFDKGGTWEFLQAPAFTGYGEKINCELSQGCSLHLAQRLSQLLNLQLRRMPILSKESAPGLIIATGSVGKNLASKTNVYISSSAGARWREALPGPHYYTWGDHGGIITAIAQGMETNELKYSTNEGETWKTFIFSEKPVFVYGLLTEPGEKSTVFTIFGSNKENVHSWLILQVNATDALGVPCTENDYKLWSPSDERGNECLLGHKTVFKRRTPHATCFNGEDFDRPVVVSNCSCTREDYECDFGFKMSEDLSLEVCVPDPEFSGKSYSPPVPCPVGSTYRRTRGYRKISGDTCSGGDVEARLEGELVPCPLAEENEFILYAVRKSIYRYDLASGATEQLPLTGLRAAVALDFDYEHNCLYWSDLALDVIQRLCLNGSTGQEVIINSGLETVEALAFEPLSQLLYWVDAGFKKIEVANPDGDFRLTIVNSSVLDRPRALVLVPQEGVMFWTDWGDLKPGIYRSNMDGSAAYHLVSEDVKWPNGISVDDQWIYWTDAYLECIERITFSGQQRSVILDNLPHPYAIAVFKNEIYWDDWSQLSIFRASKYSGSQMEILANQLTGLMDMKIFYKGKNTGSNACVPRPCSLLCLPKANNSRSCRCPEDVSSSVLPSGDLMCDCPQGYQLKNNTCVKQENTCLRNQYRCSNGNCINSIWWCDFDNDCGDMSDERNCPTTICDLDTQFRCQESGTCIPLSYKCDLEDDCGDNSDESHCEMHQCRSDEYNCSSGMCIRSSWVCDGDNDCRDWSDEANCTAIYHTCEASNFQCRNGHCIPQRWACDGDTDCQDGSDEDPVNCEKKCNGFRCPNGTCIPSSKHCDGLRDCSDGSDEQHCEPLCTHFMDFVCKNRQQCLFHSMVCDGIIQCRDGSDEDAAFAGCSQDPEFHKVCDEFGFQCQNGVCISLIWKCDGMDDCGDYSDEANCENPTEAPNCSRYFQFRCENGHCIPNRWKCDRENDCGDWSDEKDCGDSHILPFSTPGPSTCLPNYYRCSSGTCVMDTWVCDGYRDCADGSDEEACPLLANVTAASTPTQLGRCDRFEFECHQPKTCIPNWKRCDGHQDCQDGRDEANCPTHSTLTCMSREFQCEDGEACIVLSERCDGFLDCSDESDEKACSDELTVYKVQNLQWTADFSGDVTLTWMRPKKMPSASCVYNVYYRVVGESIWKTLETHSNKTNTVLKVLKPDTTYQVKVQVQCLSKAHNTNDFVTLRTPEGLPDAPRNLQLSLPREAEGVIVGHWAPPIHTHGLIREYIVEYSRSGSKMWASQRAASNFTEIKNLLVNTLYTVRVAAVTSRGIGNWSDSKSITTIKGKVIPPPDIHIDSYGENYLSFTLTMESDIKVNGYVVNLFWAFDTHKQERRTLNFRGSILSHKVGNLTAHTSYEISAWAKTDLGDSPLAFEHVMTRGVRPPAPSLKAKAINQTAVECTWTGPRNVVYGIFYATSFLDLYRNPKSLTTSLHNKTVIVSKDEQYLFLVRVVVPYQGPSSDYVVVKMIPDSRLPPRHLHVVHTGKTSVVIKWESPYDSPDQDLLYAVAVKDLIRKTDRSYKVKSRNSTVEYTLNKLEPGGKYHIIVQLGNMSKDSSIKITTVSLSAPDALKIITENDHVLLFWKSLALKEKHFNESRGYEIHMFDSAMNITAYLGNTTDNFFKISNLKMGHNYTFTVQARCLFGNQICGEPAILLYDELGSGADASATQAARSTDVA

SEQ ID NO: 3024 - protein, 755 aa, synthetic construct
  REGION 1..755: note = SORT1 (Q99523) SP+PP+ECD
MERPWGAADGLSRWPHGLGLLLLLQLLPPSTLSQDRLDAPPPPAAPLPRWSGPIGVSWGLRAAAAGGAFPRGGRWRRSAPGEDEECGRVRDFVAKLANNTHQHVFDDLRGSVSLSWVGDSTGVILVLTTFHVPLVIMTFGQSKLYRSEDYGKNFKDITDLINNTFIRTEFGMAIGPENSGKVVLTAEVSGGSRGGRIFRSSDFAKNFVQTDLPFHPLTQMMYSPQNSDYLLALSTENGLWVSKNFGGKWEEIHKAVCLAKWGSDNTIFFTTYANGSCKADLGALELWRTSDLGKSFKTIGVKIYSFGLGGRFLFASVMADKDTTRRIHVSTDQGDTWSMAQLPSVGQEQFYSILAANDDMVFMHVDEPGDTGFGTIFTSDDRGIVYSKSLDRHLYTTTGGETDFTNVTSLRGVYITSVLSEDNSIQTMITFDQGGRWTHLRKPENSECDATAKNKNECSLHIHASYSISQKLNVPMAPLSEPNAVGIVIAHGSVGDAISVMVPDVYISDDGGYSWTKMLEGPHYYTILDSGGIIVAIEHSSRPINVIKFSTDEGQCWQTYTFTRDPIYFTGLASEPGARSMNISIWGFTESFLTSQWVSYTIDFKDILERNCEEKDYTIWLAHSTDPEDYEDGCILGYKEQFLRLRKSSVCQNGRDYVVTKQPSICLCSLEDFLCDFGYYRPENDSKCVEQPELKGHDLEFCLYGREEHLTTNGYRKIPGDKCQGGVNPVREVKDLKKKCTSNFLSPEKQNSKSN

SEQ ID NO: 3025 - protein, 221 aa, synthetic construct
  REGION 1..221: note = SPACA1 (Q9HBV2) SP+PP+ECD
MSPRGTGCSAGLLMTVGWLLLAGLQSARGTNVTAAVQDAGLAHEGEGEEETENNDSETAENYAPPETEDVSNRNVVKEVEFGMCTVTCGIGVREVILTNGCPGGESKCVVRVEECRGPTDCGWGKPISESLESVRLACIHTSPLNRFKYMWKLLRQDQQSIILVNDSAILEVRKESHPLAFECDTLDNNEIVATIKFTVYTSSELQMRRSSLPATDAALIF

SEQ ID NO: 3026 - protein, 197 aa, synthetic construct
  REGION 1..197: note = SPINT2 (O43291) SP+PP+ECD
MAQLCGLRRSRAFLALLGSLLLSGVLAADRERSIHDFCLVSKVVGRCRASMPRWWYNVTDGSCQLFVYGGCDGNSNNYLTKEECLKKCATVTENATGDLATSRNAADSSVPSAPRRQDSEDHSSDMFNYEEYCTANAVTGPCRASFPRWYFDVERNSCNNFIYGGCRGNKNSYRSEEACMLRCFRQQENPPLPLGSK

SEQ ID NO: 3027 - protein, 253 aa, synthetic construct
  REGION 1..253: note = SPN (P16150) SP+PP+ECD
MATLLLLLGVLVVSPDALGSTTAVQTPTSGEPLVSTSEPLSSKMYTTSITSDPKADSTGDQTSALPPSTSINEGSPLWTSIGASTGSPLPEPTTYQEVSIKMSSVPQETPHATSHPAVPITANSLGSHTVTGGTITTNSPETSSRTSGAPVTTAASSLETSRGTSGPPLTMATVSLETSKGTSGPPVTMATDSLETSTGTTGPPVTMTTGSLEPSSGASGPQVSSVKLSTMMSPTTSTNASTVPFRNPDENSR

SEQ ID NO: 3028 - protein, 207 aa, synthetic construct
  REGION 1..207: note = SSR1 (P43307) SP+PP+ECD
MRLLPRLLLLLLLVFPATVLFRGGPRGLLAVAQDLTEDEETVEDSIIEDEDDEAEVEEDEPTDLVEDKEEEDVSGEPEASPSADTTILFVKGEDFPANNIVKFLVGFTNKGTEDFIVESLDASFRYPQDYQFYIQNFTALPLNTVVPPQRQATFEYSFIPAEPMGGRPFGLVINLNYKDLNGNVFQDAVFNQTVTVIEREDGLDGET

SEQ ID NO: 3029 - protein, 2478 aa, synthetic construct
  REGION 1..2478: note = STAB1 (Q9NY15) SP+PP+ECD
MAGPRGLLPLCLLAFCLAGFSFVRGQVLFKGCDVKTTFVTHVPCTSCAAIKKQTCPSGWLRELPDQITQDCRYEVQLGGSMVSMSGCRRKCRKQVVQKACCPGYWGSRCHECPGGAETPCNGHGTCLDGMDRNGTCVCQENFRGSACQECQDPNRFGPDCQSVCSCVHGVCNHGPRGDGSCLCFAGYTGPHCDQELPVCQELRCPQNTQCSAEAPSCRCLPGYTQQGSECRAPNPCWPSPCSLLAQCSVSPKGQAQCHCPENYHGDGMVCLPKDPCTDNLGGCPSNSTLCVYQKPGQAFCTCRPGLVSINSNASAGCFAFCSPFSCDRSATCQVTADGKTSCVCRESEVGDGRACYGHLLHEVQKATQTGRVFLQLRVAVAMMDQGCREILTTAGPFTVLVPSVSSFSSRTMNASLAQQLCRQHIIAGQHILEDTRTQQTRRWWTLAGQEITVTFNQFTKYSYKYKDQPQQTFNIYKANNIAANGVFHVVTGLRWQAPSGTPGDPKRTIGQILASTEAFSRFETILENCGLPSILDGPGPFTVFAPSNEAVDSLRDGRLIYLFTAGLSKLQELVRYHIYNHGQLTVEKLISKGRILTMANQVLAVNISEEGRILLGPEGVPLQRVDVMAANGVIHMLDGILLPPTILPILPKHCSEEQHKIVAGSCVDCQALNTSTCPPNSVKLDIFPKECVYIHDPTGLNVLKKGCASYCNQTIMEQGCCKGFFGPDCTQCPGGFSNPCYGKGNCSDGIQGNGACLCFPDYKGIACHICSNPNKHGEQCQEDCGCVHGLCDNRPGSGGVCQQGTCAPGFSGRFCNESMGDCGPTGLAQHCHLHARCVSQEGVARCRCLDGFEGDGFSCTPSNPCSHPDRGGCSENAECVPGSLGTHHCTCHKGWSGDGRVCVAIDECELDMRGGCHTDALCSYVGPGQSRCTCKLGFAGDGYQCSPIDPCRAGNGGCHGLATCRAVGGGQRVCTCPPGFGGDGFSCYGDIFRELEANAHFSIFYQWLKSAGITLPADRRVTALVPSEAAVRQLSPEDRAFWLQPRTLPNLVRAHFLQGALFEEELARLGGQEVATLNPTTRWEIRNISGRVWVQNASVDVADLLATNGVLHILSQVLLPPRGDVPGGQGLLQQLDLVPAFSLFRELLQHHGLVPQIEAATAYTIFVPTNRSLEAQGNSSHLDADTVRHHVVLGEALSMETLRKGGHRNSLLGPAHWIVFYNHSGQPEVNHVPLEGPMLEAPGRSLIGLSGVLTVGSSRCLHSHAEALREKCVNCTRRFRCTQGFQLQDTPRKSCVYRSGFSFSRGCSYTCAKKIQVPDCCPGFFGTLCEPCPGGLGGVCSGHGQCQDRFLGSGECHCHEGFHGTACEVCELGRYGPNCTGVCDCAHGLCQEGLQGDGSCVCNVGWQGLRCDQKITSPQCPRKCDPNANCVQDSAGASTCACAAGYSGNGIFCSEVDPCAHGHGGCSPHANCTKVAPGQRTCTCQDGYMGDGELCQEINSCLIHHGGCHIHAECIPTGPQQVSCSCREGYSGDGIRTCELLDPCSKNNGGCSPYATCKSTGDGQRTCTCDTAHTVGDGLTCRARVGLELLRDKHASFFSLRLLEYKELKGDGPFTIFVPHADLMSNLSQDELARIRAHRQLVFRYHVVGCRRLRSEDLLEQGYATALSGHPLRFSEREGSIYLNDFARVVSSDHEAVNGILHFIDRVLLPPEALHWEPDDAPIPRRNVTAAAQGFGYKIFSGLLKVAGLLPLLREASHRPFTMLWPTDAAFRALPPDRQAWLYHEDHRDKLAAILRGHMIRNVEALASDLPNLGPLRTMHGTPISFSCSRTRAGELMVGEDDARIVQRHLPFEGGLAYGIDQLLEPPGLGARCDHFETRPLRLNTCSICGLEPPCPEGSQEQGSPEACWRFYPKFWTSPPLHSLGLRSVWVHPSLWGRPQGLGRGCHRNCVTTTWKPSCCPGHYGSECQACPGGPSSPCSDRGVCMDGMSGSGQCLCRSGFAGTACELCAPGAFGPHCQACRCTVHGRCDEGLGGSGSCFCDEGWTGPRCEVQLELQPVCTPPCAPEAVCRAGNSCECSLGYEGDGRVCTVADLCQDGHGGCSEHANCSQVGTMVTCTCLPDYEGDGWSCRARNPCTDGHRGGCSEHANCLSTGLNTRRCECHAGYVGDGLQCLEESEPPVDRCLGQPPPCHSDAMCTDLHFQEKRAGVFHLQATSGPYGLNFSEAEAACEAQGAVLASFPQLSAAQQLGFHLCLMGWLANGSTAHPVVFPVADCGNGRVGIVSLGARKNLSERWDAYCFRVQDVACRCRNGFVGDGISTCNGKLLDVLAATANFSTFYGMLLGYANATQRGLDFLDFLDDELTYKTLFVPVNEGFVDNMTLSGPDLELHASNATLLSANASQGKLLPAHSGLSLIISDAGPDNSSWAPVAPGTVVVSRIIVWDIMAFNGIIHALASPLLAPPQPQAVLAPEAPPVAA

SEQ ID NO: 3030 - protein, 2458 aa, synthetic construct
  REGION 1..2458: note = STAB2 (Q8WWQ8) SP+PP+ECD
MMLQHLVIFCLGLVVQNFCSPAETTGQARRCDRKSLLTIRTECRSCALNLGVKCPDGYTMITSGSVGVRDCRYTFEVRTYSLSLPGCRHICRKDYLQPRCCPGRWGPDCIECPGGAGSPCNGRGSCAEGMEGNGTCSCQEGFGGTACETCADDNLFGPSCSSVCNCVHGVCNSGLDGDGTCECYSAYTGPKCDKPIPECAALLCPENSRCSPSTEDENKLECKCLPNYRGDGKYCDPINPCLRKICHPHAHCTYLGPNRHSCTCQEGYRGDGQVCLPVDPCQINFGNCPTKSTVCKYDGPGQSHCECKEHYQNFVPGVGCSMTDICKSDNPCHRNANCTTVAPGRTECICQKGYVGDGLTCYGNIMERLRELNTEPRGKWQGRLTSFISLLDKAYAWPLSKLGPFTVLLPTDKGLKGFNVNELLVDNKAAQYFVKLHIIAGQMNIEYMNNTDMFYTLTGKSGEIFNSDKDNQIKLKLHGGKKKVKIIQGDIIASNGLLHILDRAMDKLEPTFESNNEQTIMTMLQPRYSKFRSLLEETNLGHALDEDGVGGPYTIFVPNNEALNNMKDGTLDYLLSPEGSRKLLELVRYHIVPFTQLEVATLISTPHIRSMANQLIQFNTTDNGQILANDVAMEEIEITAKNGRIYTLTGVLIPPSIVPILPHRCDETKREMKLGTCVSCSLVYWSRCPANSEPTALFTHRCVYSGRFGSLKSGCARYCNATVKIPKCCKGFYGPDCNQCPGGFSNPCSGNGQCADSLGGNGTCICEEGFQGSQCQFCSDPNKYGPRCNKKCLCVHGTCNNRIDSDGACLTGTCRDGSAGRLCDKQTSACGPYVQFCHIHATCEYSNGTASCICKAGYEGDGTLCSEMDPCTGLTPGGCSRNAECIKTGTGTHTCVCQQGWTGNGRDCSEINNCLLPSAGGCHDNASCLYVGPGQNECECKKGFRGNGIDCEPITSCLEQTGKCHPLASCQSTSSGVWSCVCQEGYEGDGFLCYGNAAVELSFLSEAAIFNRWINNASLQPTLSATSNLTVLVPSQQATEDMDQDEKSFWLSQSNIPALIKYHMLLGTYRVADLQTLSSSDMLATSLQGNFLHLAKVDGNITIEGASIVDGDNAATNGVIHIINKVLVPQRRLTGSLPNLLMRLEQMPDYSIFRGYIIQYNLANAIEAADAYTVFAPNNNAIENYIREKKVLSLEEDVLRYHVVLEEKLLKNDLHNGMHRETMLGFSYFLSFFLHNDQLYVNEAPINYTNVATDKGVIHGLGKVLEIQKNRCDNNDTTIIRGRCRTCSSELTCPFGTKSLGNEKRRCIYTSYFMGRRTLFIGCQPKCVRTVITRECCAGFFGPQCQPCPGNAQNVCFGNGICLDGVNGTGVCECGEGFSGTACETCTEGKYGIHCDQACSCVHGRCNQGPLGDGSCDCDVGWRGVHCDNATTEDNCNGTCHTSANCLTNSDGTASCKCAAGFQGNGTICTAINACEISNGGCSAKADCKRTTPGRRVCTCKAGYTGDGIVCLEINPCLENHGGCDKNAECTQTGPNQAACNCLPAYTGDGKVCTLINVCLTKNGGCSEFAICNHTGQVERTCTCKPNYIGDGFTCRGSIYQELPKNPKTSQYFFQLQEHFVKDLVGPGPFTVFAPLSAAFDEEARVKDWDKYGLMPQVLRYHVVACHQLLLENLKLISNATSLQGEPIVISVSQSTVYINNKAKIISSDIISTNGIVHIIDKLLSPKNLLITPKDNSGRILQNLTTLATNNGYIKFSNLIQDSGLLSVITDPIHTPVTLFWPTDQALHALPAEQQDFLFNQDNKDKLKEYLKFHVIRDAKVLAVDLPTSTAWKTLQGSELSVKCGAGRDIGDLFLNGQTCRIVQRELLFDLGVAYGIDCLLIDPTLGGRCDTFTTFDASGECGSCVNTPSCPRWSKPKGVKQKCLYNLPFKRNLEGCRERCSLVIQIPRCCKGYFGRDCQACPGGPDAPCNNRGVCLDQYSATGECKCNTGFNGTACEMCWPGRFGPDCLPCGCSDHGQCDDGITGSGQCLCETGWTGPSCDTQAVLPAVCTPPCSAHATCKENNTCECNLDYEGDGITCTVVDFCKQDNGGCAKVARCSQKGTKVSCSCQKGYKGDGHSCTEIDPCADGLNGGCHEHATCKMTGPGKHKCECKSHYVGDGLNCEPEQLPIDRCLQDNGQCHADAKCVDLHFQDTTVGVFHLRSPLGQYKLTFDKAREACANEAATMATYNQLSYAQKAKYHLCSAGWLETGRVAYPTAFASQNCGSGVVGIVDYGPRPNKSEMWDVFCYRMKDVNCTCKVGYVGDGFSCSGNLLQVLMSFPSLTNFLTEVLAYSNSSARGRAFLEHLTDLSIRGTLFVPQNSGLGENETLSGRDIEHHLANVSMFFYNDLVNGTTLQTRLGSKLLITASQDPLQPTETRFVDGRAILQWDIFASNGIIHVISRPLKAPPAPVTLTHT

SEQ ID NO: 3031 - protein, 213 aa, synthetic construct
  REGION 1..213: note = STIM1 (Q13586) SP+PP+ECD
MDVCVRLALWLLWGLLLHQGQSLSHSHSEKATGTSSGANSEESTAAEFCRIDKPLCHSEDEKLSFEAVRNIHKLMDDDANGDVDVEESDEFLREDLNYHDPTVKHSTFHGEDKLISVEDLWKAWKSSEVYNWTVDEVVQWLITYVELPQYEETFRKLQLSGHAMPRLAVTNTTMTGTVLKMTDRSHRQKLQLKALDTVLFGPPLLTRHNHLKD

SEQ ID NO: 3032 - protein, 1010 aa, synthetic construct
  REGION 1..1010: note = SUCO (Q9UBS9) SP+PP+ECD
MKKHRRALALVSCLFLCSLVWLPSWRVCCKESSSASASSYYSQDDNCALENEDVQFQKKDEREGPINAESLGKSGSNLPISPKEHKLKDDSIVDVQNTESKKLSPPVVETLPTVDLHEESSNAVVDSETVENISSSSTSEITPISKLDEIEKSGTIPIAKPSETEQSETDCDVGEALDASAPIEQPSFVSPPDSLVGQHIENVSSSHGKGKITKSEFESKVSASEQGGGDPKSALNASDNLKNESSDYTKPGDIDPTSVASPKDPEDIPTFDEWKKKVMEVEKEKSQSMHASSNGGSHATKKVQKNRNNYASVECGAKILAANPEAKSTSAILIENMDLYMLNPCSTKIWFVIELCEPIQVKQLDIANYELFSSTPKDFLVSISDRYPTNKWIKLGTFHGRDERNVQSFPLDEQMYAKYVKMFIKYIKVELLSHFGSEHFCPLSLIRVFGTSMVEEYEEIADSQYHSERQELFDEDYDYPLDYNTGEDKSSKNLLGSATNAILNMVNIAANILGAKTEDLTEGNKSISENATATAAPKMPESTPVSTPVPSPEYVTTEVHTHDMEPSTPDTPKESPIVQLVQEEEEEASPSTVTLLGSGEQEDESSPWFESETQIFCSELTTICCISSFSEYIYKWCSVRVALYRQRSRTALSKGKDYLVLAQPPLLLPAESVDVSVLQPLSGELENTNIEREAETVVLGDLSSSMHQDDLVNHTVDAVELEPSHSQTLSQSLLLDITPEINPLPKIEVSESVEYEAGHIPSPVIPQESSVEIDNETEQKSESFSSIEKPSITYETNKVNELMDNIIKEDVNSMQIFTKLSETIVPPINTATVPDNEDGEAKMNIADTAKQTLISVVDSSSLPEVKEEEQSPEDALLRGLQRTATDFYAELQNSTDLGYANGNLVHGSNQKESVFMRLNNRIKALEVNMSLSGRYLEELSQRYRKQMEEMQKAFNKTIVKLQNTSRIAEEQDQRQTEAIQLLQAQLTNMTQLVSNLSATVAELKREVSDR

SEQ ID NO: 3033 - protein, 721 aa, synthetic construct
  REGION 1..721: note = SUSD1 (Q6UWL2) SP+PP+ECD
MGRGPWDAGPSRRLLPLLLLLGLARGAAGAPGPDGLDVCATCHEHATCQQREGKKICICNYGFVGNGRTQCVDKNECQFGATLVCGNHTSCHNTPGGFYCICLEGYRATNNNKTFIPNDGTFCTDIDECEVSGLCRHGGRCVNTHGSFECYCMDGYLPRNGPEPFHPTTDATSCTEIDCGTPPEVPDGYIIGNYTSSLGSQVRYACREGFFSVPEDTVSSCTGLGTWESPKLHCQEINCGNPPEMRHAILVGNHSSRLGGVARYVCQEGFESPGGKITSVCTEKGTWRESTLTCTEILTKINDVSLFNDTCVRWQINSRRINPKISYVISIKGQRLDPMESVREETVNLTTDSRTPEVCLALYPGTNYTVNISTAPPRRSMPAVIGFQTAEVDLLEDDGSFNISIFNETCLKLNRRSRKVGSEHMYQFTVLGQRWYLANFSHATSFNFTTREQVPVVCLDLYPTTDYTVNVTLLRSPKRHSVQITIATPPAVKQTISNISGFNETCLRWRSIKTADMEEMYLFHIWGQRWYQKEFAQEMTFNISSSSRDPEVCLDLRPGTNYNVSLRALSSELPVVISLTTQITEPPLPEVEFFTVHRGPLPRLRLRKAKEKNGPISSYQVLVLPLALQSTFSCDSEGASSFFSNASDADGYVAAELLAKDVPDDAMEIPIGDRLYYGEYYNAPLKRGSDYCIILRITSEWNKVRRHSCAVWAQVKDSSLM

SEQ ID NO: 3034 - protein, 785 aa, synthetic construct
  REGION 1..785: note = SUSD2 (Q9UGT4) SP+PP+ECD
MKPALLPWALLLLATALGPGPGPTADAQESCSMRCGALDGPCSCHPTCSGLGTCCLDFRDFCLEILPYSGSMMGGKDFVVRHFKMSSPTDASVICRFKDSIQTLGHVDSSGQVHCVSPLLYESGRIPFTVSLDNGHSFPRAGTWLAVHPNKVSMMEKSELVNETRWQYYGTANTSGNLSLTWHVKSLPTQTITIELWGYEETGMPYSQEWTAKWSYLYPLATHIPNSGSFTFTPKPAPPSYQRWRVGALRIIDSKNYAGQKDVQALWTNDHALAWHLSDDFREDPVAWARTQCQAWEELEDQLPNFLEELPDCPCTLTQARADSGRFFTDYGCDMEQGSVCTYHPGAVHCVRSVQASLRYGSGQQCCYTADGTQLLTADSSGGSTPDRGHDWGAPPFRTPPRVPSMSHWLYDVLSFYYCCLWAPDCPRYMQRRPSNDCRNYRPPRLASAFGDPHFVTFDGTNFTFNGRGEYVLLEAALTDLRVQARAQPGTMSNGTETRGTGLTAVAVQEGNSDVVEVRLANRTGGLEVLLNQEVLSFTEQSWMDLKGMFLSVAAGDRVSIMLASGAGLEVSVQGPFLSVSVLLPEKFLTHTHGLLGTLNNDPTDDFTLHSGRVLPPGTSPQELFLFGANWTVHNASSLLTYDSWFLVHNFLYQPKHDPTFEPLFPSETTLNPSLAQEAAKLCGDDHFCNFDVAATGSLSTGTATRVAHQLHQRRMQSLQPVVSCGWLAPPPNGQKEGNRYLAGSTIYFHCDNGYSLAGAETSTCQADGTWSSPTPKCQPGRSYA

SEQ ID NO: 3035 - protein, 319 aa, synthetic construct
  REGION 1..319: note = SUSD4 (Q5VX71) SP+PP+ECD
MYHGMNPSNGDGFLEQQQQQQQPQSPQRLLAVILWFQLALCFGPAQLTGGFDDLQVCADPGIPENGFRTPSGGVFFEGSVARFHCQDGFKLKGATKRLCLKHFNGTLGWIPSDNSICVQEDCRIPQIEDAEIHNKTYRHGEKLIITCHEGFKIRYPDLHNMVSLCRDDGTWNNLPICQGCLRPLASSNGYVNISELQTSFPVGTVISYRCFPGFKLDGSAYLECLQNLIWSSSPPRCLALEVCPLPPMVSHGDFVCHPRPCERYNHGTVVEFYCDPGYSLTSDYKYITCQYGEWFPSYQVYCIKSEQTWPSTHETLLTT

SEQ ID NO: 3036 - protein, 574 aa, synthetic construct
  REGION 1..574: note = SUSD5 (O60279) SP+PP+ECD
MTAEGPSPPARWHRRLPGLWAAALLLLGLPRLSVRADGKFFVLESQNGSQGLQLEAARLSCKSRGAHLASADELRRVVQDCSFAVCTTGWLADGTLGTTVCSKGSGEQQIMRAVDVRIESNPVPGGTYSALCIKDEEKPCGDPPSFPHTILQGRTGLEMGDELLYVCAPGHIMGHRETAFTLLCNSCGEWYGLVQACGKDEAEAHIDYEDNFPDDRSVSFRELMEDSRTEADEDRGQGDSSEEAPKQDRLVSISVGRENIARDKVFVPTTGLPGAGSSVPADSPGSRLLQKHLFWFPAEAFHKPGLEKEVDDDTKKQFSAGDNHSGVKLVPGEPETKVIYGNTDGPSGPFVGKNDSKAGDPVVSSSDESWLDGYPVTEGAWRKTEAEEEEDGDRGDGSVGLDENVLVTPDQPILVEVKKPKSSTLTPSEGMTHSSVLPSQMLDVEALALRPVNASETEGIGDGDLTKYQSTLPWRFITEESPMATLSYELTSSTLEILTVNTVKQTPNHIPSTIMATTQPPVETTVPEIQDSFPYLLSEDFFGQEGPGPGASEELHPTLESCVGDGCPGLSRGP

SEQ ID NO: 3037 - protein, 274 aa, synthetic construct
  REGION 1..274: note = TACSTD2 (P09758) SP+PP+ECD
MARGPGLAPPPLRLPLLLLVLAAVTGHTAAQDNCTCPTNKMTVCSPDGPGGRCQCRALGSGMAVDCSTLTSKCLLLKARMSAPKNARTLVRPSEHALVDNDGLYDPDCDPEGRFKARQCNQTSVCWCVNSVGVRRTDKGDLSLRCDELVRTHHILIDLRHRPTAGAFNHSDLDAELRRLFRERYRLHPKFVAAVHYEQPTIQIELRQNTSQKAAGDVDIGDAAYYFERDIKGESLFQGRGGLDLRVRGEPLQVERTLIYYLDEIPPKFSMKRLT

SEQ ID NO: 3038 - protein, 236 aa, synthetic construct
  REGION 1..236: note = TARM1 (B6A8C7) SP+PP+ECD
MIPKLLSLLCFRLCVGQGDTRGDGSLPKPSLSAWPSSVVPANSNVTLRCWTPARGVSFVLRKGGIILESPKPLDSTEGAAEFHLNNLKVRNAGEYTCEYYRKASPHILSQRSDVLLLLVTGHLSKPFLRTYQRGTVTAGGRVTLQCQKRDQLFVPIMFALLKAGTPSPIQLQSPAGKEIDFSLVDVTAGDAGNYSCMYYQTKSPFWASEPSDQLEILVTVPPGTTSSNYSLGNFVR

SEQ ID NO: 3039 - protein, 668 aa, synthetic construct
  REGION 1..668: note = TCTN2 (Q96GX1) SP+PP+ECD
MGFQPPAALLLRLFLLQGILRLLWGDLAFIPPFIRMSGPAVSASLVGDTEGVTVSLAVLQDEAGILPIPTCGVLNNETEDWSVTVIPGAKVLEVTVRWKRGLDWCSSNETDSFSESPCILQTLLVSASHNSSCSAHLLIQVEIYANSSLTHNASENVTVIPNQVYQPLGPCPCNLTAGACDVRCCCDQECSSNLTTLFRRSCFTGVFGGDVNPPFDQLCSAGTTTRGVPDWFPFLCVQSPLANTPFLGYFYHGAVSPKQDSSFEVYVDTDAKDFADFGYKQGDPIMTVKKAYFTIPQVSLAGQCMQNAPVAFLHNFDVKCVTNLELYQERDGIINAKIKNVALGGIVTPKVIYEEATDLDKFITNTETPLNNGSTPRIVNVEEHYIFKWNNNTISEINVKIFRAEINAHQKGIMTQRFVVKFLSYNSGNEEELSGNPGYQLGKPVRALNINRMNNVTTLHLWQSAGRGLCTSATFKPILFGENVLSGCLLEVGINENCTQLRENAVERLDSLIQATHVAMRGNSDYADLSDGWLEIIRVDAPDPGADPLASSVNGMCLDIPAHLSIRILISDAGAVEGITQQEILGVETRFSSVNWQYQCGLTCEHKADLLPISASVQFIKIPAQLPHPLTRFQINYTEYDCNRNEVCWPQLLYPWTQYYQGELHSQC

SEQ ID NO: 3040 - protein, 581 aa, synthetic construct
  REGION 1..581: note = TCTN3 (Q6NUS6) SP+PP+ECD
MRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNSNLNYFQKLQKVNATNFQALAAEFGGESFTSTFQTQSPPSFYRAGDPILTYFPKWSVISLLRQPAGVGAGGLCAESNPAGFLESKSTTCTRFFKNLASSCTLDSALNAASYYNFTVLKVPRSMTDPQNMEFQVPVILTSQANAPLLAGNTCQNVVSQVTYEIETNGTFGIQKVSVSLGQTNLTVEPGASLQQHFILRFRAFQQSTAASLTSPRSGNPGYIVGKPLLALTDDISYSMTLLQSQGNGSCSVKRHEVQFGVNAISGCKLRLKKADCSHLQQEIYQTLHGRPRPEYVAIFGNADPAQKGGWTRILNRHCSISAINCTSCCLIPVSLEIQVLWAYVGLLSNPQAHVSGVRFLYQCQSIQDSQQVTEVSLTTLVNFVDITQKPQPPRGQPKMDWKWPFDFFPFKVAFSRGV

SEQ ID NO: 3041 - protein, 748 aa, synthetic construct
  REGION 1..748: note = TEK (Q02763) SP+PP+ECD
MDSLASLVLCGVSLLLSGTVEGAMDLILINSLPLVSDAETSLTCIASGWRPHEPITIGRDFEALMNQHQDPLEVTQDVTREWAKKVVWKREKASKINGAYFCEGRVRGEAIRIRTMKMRQQASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEACHPGFYGPDCKLRCSCNNGEMCDRFQGCLCSPGWQGLQCEREGIQRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVISWTILDGYSISSITIRYKVQGKNEDQHVDVKIKNATITQYQLKGLEPETAYQVDIFAENNIGSSNPAFSHELVTLPESQAPADLGGGKMLL

SEQ ID NO: 3042 - protein, 98 aa, synthetic construct
  REGION 1..98: note = TGFA (P01135) SP+PP+ECD
MVPSAGQLALFALGIVLAACQALENSTSPLSADPPVAAAVVSHFNDCPDSHTQFCFHGTCRFLVQEDKPACVCHSGYVGARCEHADLLAVVAASQKKQ

SEQ ID NO: 3043 - protein, 126 aa, synthetic construct
  REGION 1..126: note = TGFBR1 (P36897) SP+PP+ECD
MEAAVAAPRPRLLLLVLAAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTVKSSPGLGPVEL

SEQ ID NO: 3044 - protein, 166 aa, synthetic construct
  REGION 1..166: note = TGFBR2 (P37173) SP+PP+ECD
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQ

SEQ ID NO: 3045 - protein, 787 aa, synthetic construct
  REGION 1..787: note = TGFBR3 (Q03167) SP+PP+ECD
MTSHYVIAIFALMSSCLATAGPEPGALCELSPVSASHPVQALMESFTVLSGCASRGTTGLPQEVHVLNLRTAGQGPGQLQREVTLHLNPISSVHIHHKSVVFLLNSPHPLVWHLKTERLATGVSRLFLVSEGSVVQFSSANFSLTAETEERNFPHGNEHLLNWARKEYGAVTSFTELKIARNIYIKVGEDQVFPPKCNIGKNFLSLNYLAEYLQPKAAEGCVMSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNAEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKEKGPSMKEPNPISPPIFHGLDTLTV

SEQ ID NO: 3046 - protein, 381 aa, synthetic construct
  REGION 1..381: note = TGOLN2 (O43493) SP+PP+ECD
MRFVVALVLLNVAAAGAVPLLATESVKQEEAGVRPSAGNVSTHPSLSQRPGGSTKSHPEPQTPKDSPSKSSAEAQTPEDTPNKSGAEAKTQKDSSNKSGAEAKTQKGSTSKSGSEAQTTKDSTSKSHPELQTPKDSTGKSGAEAQTPEDSPNRSGAEAKTQKDSPSKSGSEAQTTKDVPNKSGADGQTPKDGSSKSGAEDQTPKDVPNKSGAEKQTPKDGSNKSGAEEQGPIDGPSKSGAEEQTSKDSPNKVVPEQPSRKDHSKPISNPSDNKELPKADTNQLADKGKLSPHAFKTESGEETDLISPPQEEVKSSEPTEDVEPKEAEDDDTGPEEGSPPKEEKEKMSGSASSENREGTLSDSTGSEKDDLYPNGSGNGSAE

SEQ ID NO: 3047 - protein, 515 aa, synthetic construct
  REGION 1..515: note = THBD (P07204) SP+PP+ECD
MLGVLVLGALALAGLGFPAPAEPQPGGSQCVEHDCFALYPGPATFLNASQICDGLRGHLMTVRSSVAADVISLLLNGDGGVGRRRLWIGLQLPPGCGDPKRLGPLRGFQWVTGDNNTSYSRWARLDLNGAPLCGPLCVAVSAAEATVPSEPIWEEQQCEVKADGFLCEFHFPATCRPLAVEPGAAAAAVSITYGTPFAARGADFQALPVGSSAAVAPLGLQLMCTAPPGAVQGHWAREAPGAWDCSVENGGCEHACNAIPGAPRCQCPAGAALQADGRSCTASATQSCNDLCEHFCVPNPDQPGSYSCMCETGYRLAADQHRCEDVDDCILEPSPCPQRCVNTQGGFECHCYPNYDLVDGECVEPVDPCFRANCEYQCQPLNQTSYLCVCAEGFAPIPHEPHRCQMFCNQTACPADCDPNTQASCECPEGYILDDGFICTDIDECENGGFCSGVCHNLPGTFECICGPDSALARHIGTDCDSGKVDGGDSGSGEPPPSPTPGSTLTPPAVGLVHS

SEQ ID NO: 3048 - protein, 413 aa, synthetic construct
  REGION 1..413: note = THSD1 (Q9NS62) SP+PP+ECD
MKPMLKDFSNLLLVVLCDYVLGEAEYLLLREPGHVALSNDTVYVDFQYFDGANGTLRNVSVLLLEANTNQTVTTKYLLTNQSQGTLKFECFYFKEAGDYWFTMTPEATDNSTPFPWWEKSAFLKVEWPVFHVDLNRSAKAAEGTFQVGLFTSQPLCPFPVDKPNIVVDVIFTNSLPEARRNSRQPLEIRTSKRTELAQGQWVEFGCAPLGPEAYVTVVLKLLGRDSVITSTGPIDLAQKFGYKLVMVPELTCESGVEVTVLPPPCTFVQGVVTVFKEAPRYPGKRTIHLAENSLPLGERRTIFNCTLFDMGKNKYCFDFGISSRSHFSAKEECMLIQRNTETWGLWQPWSQCSATCGDGVRERRRVCLTSFPSSPVCPGMSLEASLCSLEECAAFQPSSPSPLQPQGPVKSNN

SEQ ID NO: 3049 - protein, 1607 aa, synthetic construct
  REGION 1..1607: note = THSD7A (Q9UPZ6) SP+PP+ECD
MGLQARRWASGSRGAAGPRRGVLQLLPLPLPLPLLLLLLLRPGAGRAAAQGEAEAPTLYLWKTGPWGRCMGDECGPGGIQTRAVWCAHVEGWTTLHTNCKQAERPNNQQNCFKVCDWHKELYDWRLGPWNQCQPVISKSLEKPLECIKGEEGIQVREIACIQKDKDIPAEDIICEYFEPKPLLEQACLIPCQQDCIVSEFSAWSECSKTCGSGLQHRTRHVVAPPQFGGSGCPNLTEFQVCQSSPCEAEELRYSLHVGPWSTCSMPHSRQVRQARRRGKNKEREKDRSKGVKDPEARELIKKKRNRNRQNRQENKYWDIQIGYQTREVMCINKTGKAADLSFCQQEKLPMTFQSCVITKECQVSEWSEWSPCSKTCHDMVSPAGTRVRTRTIRQFPIGSEKECPEFEEKEPCLSQGDGVVPCATYGWRTTEWTECRVDPLLSQQDKRRGNQTALCGGGIQTREVYCVQANENLLSQLSTHKNKEASKPMDLKLCTGPIPNTTQLCHIPCPTECEVSPWSAWGPCTYENCNDQQGKKGFKLRKRRITNEPTGGSGVTGNCPHLLEAIPCEEPACYDWKAVRLGNCEPDNGKECGPGTQVQEVVCINSDGEEVDRQLCRDAIFPIPVACDAPCPKDCVLSTWSTWSSCSHTCSGKTTEGKQIRARSILAYAGEEGGIRCPNSSALQEVRSCNEHPCTVYHWQTGPWGQCIEDTSVSSFNTTTTWNGEASCSVGMQTRKVICVRVNVGQVGPKKCPESLRPETVRPCLLPCKKDCIVTPYSDWTSCPSSCKEGDSSIRKQSRHRVIIQLPANGGRDCTDPLYEEKACEAPQACQSYRWKTHKWRRCQLVPWSVQQDSPGAQEGCGPGRQARAITCRKQDGGQAGIHECLQYAGPVPALTQACQIPCQDDCQLTSWSKFSSCNGDCGAVRTRKRTLVGKSKKKEKCKNSHLYPLIETQYCPCDKYNAQPVGNWSDCILPEGKVEVLLGMKVQGDIKECGQGYRYQAMACYDQNGRLVETSRCNSHGYIEEACIIPCPSDCKLSEWSNWSRCSKSCGSGVKVRSKWLREKPYNGGRPCPKLDHVNQAQVYEVVPCHSDCNQYLWVTEPWSICKVTFVNMRENCGEGVQTRKVRCMQNTADGPSEHVEDYLCDPEEMPLGSRVCKLPCPEDCVISEWGPWTQCVLPCNQSSFRQRSADPIRQPADEGRSCPNAVEKEPCNLNKNCYHYDYNVTDWSTCQLSEKAVCGNGIKTRMLDCVRSDGKSVDLKYCEALGLEKNWQMNTSCMVECPVNCQLSDWSPWSECSQTCGLTGKMIRRRTVTQPFQGDGRPCPSLMDQSKPCPVKPCYRWQYGQWSPCQVQEAQCGEGTRTRNISCVVSDGSADDFSKVVDEEFCADIELIIDGNKNMVLEESCSQPCPGDCYLKDWSSWSLCQLTCVNGEDLGFGGIQVRSRPVIIQELENQHLCPEQMLETKSCYDGQCYEYKWMASAWKGSSRTVWCQRSDGINVTGGCLVMSQPDADRSCNPPCSQPHSYCSETKTCHCEEGYTEVMSSNSTLEQCTLIPVVVLPTMEDKRGDVKTSRAVHPTQPSSNPAGRGRTWFLQPFGPDGRLKTW

SEQ ID NO: 3050 - protein, 1555 aa, synthetic construct
  REGION 1..1555: note = THSD7B (Q9C0I4) SP+PP+ECD
MFPKSNLTVTCWVWRSMRKLFLLLSLLLSHAAHLEGKKDNQFIWKPGPWGRCTGDCGPGGVQSRAVWCFHVDGWTSHLSNCGESNRPPKERSCFRVCDWHSDLFQWEVSDWHHCVLVPYARGEVKPRTAECVTAQHGLQHRMVRCIQKLNRTVVANEICEHFALQPPTEQACLIPCPRDCVVSEFLPWSNCSKGCGKKLQHRTRAVIAPPLFGGLQCPNLTESRACDAPISCPLGEEEYTFSLKVGPWSKCRLPHLKEINPSGRTVLDFNSDSNERVTFKHQSYKAHHHSKSWAIEIGYQTRQVSCTRSDGQNAMLSLCLQDSFPLTVQSCIMPKDCETSQWSSWSPCSKTCRSGSLLPGFRSRSRNVKHMAIGGGKECPELLEKEACIVEGELLQQCPRYSWRTSEWKECQVSLLLEQQDPHWHVTGPVCGGGIQTREVYCAQSVPAAAALRAKEVSRPVEKALCVGPAPLPSQLCNIPCSTDCIVSSWSAWGLCIHENCHDPQGKKGFRTRQRHVLMESTGPAGHCPHLVESVPCEDPMCYRWLASEGICFPDHGKCGLGHRILKAVCQNDRGEDVSGSLCPVPPPPERKSCEIPCRMDCVLSEWTEWSSCSQSCSNKNSDGKQTRSRTILALAGEGGKPCPPSQALQEHRLCNDHSCMQLHWETSPWGPCSEDTLVTALNATIGWNGEATCGVGIQTRRVFCVKSHVGQVMTKRCPDSTRPETVRPCFLPCKKDCIVTAFSEWTPCPRMCQAGNATVKQSRYRIIIQEAANGGQECPDTLYEERECEDVSLCPVYRWKPQKWSPCILVPESVWQGITGSSEACGKGLQTRAVSCISDDNRSAEMMECLKQTNGMPLLVQECTVPCREDCTFTAWSKFTPCSTNCEATKSRRRQLTGKSRKKEKCQDSDLYPLVETELCPCDEFISQPYGNWSDCILPEGRREPHRGLRVQADSKECGEGLRFRAVACSDKNGRPVDPSFCSSSGYIQEKCVIPCPFDCKLSDWSSWGSCSSSCGIGVRIRSKWLKEKPYNGGRPCPKLDLKNQVHEAVPCYSECNQYSWVVEHWSSCKINNELRSLRCGGGTQSRKIRCVNTADGEGGAVDSNLCNQDEIPPETQSCSLMCPNECVMSEWGLWSKCPQSCDPHTMQRRTRHLLRPSLNSRTCAEDSQVQPCLLNENCFQFQYNLTEWSTCQLSENAPCGQGVRTRLLSCVCSDGKPVSMDQCEQHNLEKPQRMSIPCLVECVVNCQLSGWTAWTECSQTCGHGGRMSRTRFIIMPTQGEGRPCPTELTQEKTCPVTPCYSWVLGNWSACKLEGGDCGEGVQIRSLSCMVHSGSISHAAGRVEDALCGEMPFQDSILKQLCSVPCPGDCHLTEWSEWSTCELTCIDGRSFETVGRQSRSRTFIIQSFENQDSCPQQVLETRPCTGGKCYHYTWKASLWNNNERTVWCQRSDGVNVTGGCSPQARPAAIRQCIPACRKPFSYCTQGGVCGCEKGYTEIMKSNGFLDYCMKVPGSEDKKADVKNLSGKNRPVNSKIHDIFKGWSLQPLDPDGRVK

SEQ ID NO: 3051 - protein, 759 aa, synthetic construct
  REGION 1..759: note = TIE1 (P35590) SP+PP+ECD
MVWRVPPFLLPILFLASHVGAAVDLTLLANLRLTDPQRFFLTCVSGEAGAGRGSDAWGPPLLLEKDDRIVRTPPGPPLRLARNGSHQVTLRGFSKPSDLVGVFSCVGGAGARRTRVIYVHNSPGAHLLPDKVTHTVNKGDTAVLSARVHKEKQTDVIWKSNGSYFYTLDWHEAQDGRFLLQLPNVQPPSSGIYSATYLEASPLGSAFFRLIVRGCGAGRWGPGCTKECPGCLHGGVCHDHDGECVCPPGFTGTRCEQACREGRFGQSCQEQCPGISGCRGLTFCLPDPYGCSCGSGWRGSQCQEACAPGHFGADCRLQCQCQNGGTCDRFSGCVCPSGWHGVHCEKSDRIPQILNMASELEFNLETMPRINCAAAGNPFPVRGSIELRKPDGTVLLSTKAIVEPEKTTAEFEVPRLVLADSGFWECRVSTSGGQDSRRFKVNVKVPPVPLAAPRLLTKQSRQLVVSPLVSFSGDGPISTVRLHYRPQDSTMDWSTIVVDPSENVTLMNLRPKTGYSVRVQLSRPGEGGEGAWGPPTLMTTDCPEPLLQPWLEGWHVEGTDRLRVSWSLPLVPGPLVGDGFLLRLWDGTRGQERRENVSSPQARTALLTGLTPGTHYQLDVQLYHCTLLGPASPPAHVLLPPSGPPAPRHLHAQALSDSEIQLTWKHPEALPGPISKYVVEVQVAGGAGDPLWIDVDRPEETSTIIRGLNASTRYLFRMRASIQGLGDWSNTVEESTLGNGLQAEGPVQESRAAEEGLDQ

SEQ ID NO: 3052 - protein, 141 aa, synthetic construct
  REGION 1..141: note = TIGIT (Q495A1) SP+PP+ECD
MRWCLLLIWAQGLRQAPLASGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIP

SEQ ID NO: 3053 - protein, 314 aa, synthetic construct
  REGION 1..314: note = TIMD4 (Q96H15) SP+PP+ECD
MSKEPLILWLMIEFWWLYLTPVTSETVVTEVLGHRVTLPCLYSSWSHNSNSMCWGKDQCPYSGCKEALIRTDGMRVTSRKSAKYRLQGTIPRGDVSLTILNPSESDSGVYCCRIEVPGWFNDVKINVRLNLQRASTTTHRTATTTTRRTTTTSPTTTRQMTTTPAALPTTVVTTPDLTTGTPLQMTTIAVFTTANTCLSLTPSTLPEEATGLLTPEPSKEGPILTAESETVLPSDSWSSVESTSADTVLLTSKESKVWDLPSTSHVSMWKTSDSVSSPQPGASDTAVPEQNKTTKTGQMDGIPMSMKNEMPISQ

SEQ ID NO: 3054 - protein, 580 aa, synthetic construct
  REGION 1..580: note = TLR1 (Q15399) SP+PP+ECD
MTSIFHFAIIFMLILQIRIQLSEESEFLVDRSKNGLIHVPKDLSQKTTILNISQNYISELWTSDILSLSKLRILIISHNRIQYLDISVFKFNQELEYLDLSHNKLVKISCHPTVNLKHLDLSFNAFDALPICKEFGNMSQLKFLGLSTTHLEKSSVLPIAHLNISKVLLVLGETYGEKEDPEGLQDFNTESLHIVFPTNKEFHFILDVSVKTVANLELSNIKCVLEDNKCSYFLSILAKLQTNPKLSNLTLNNIETTWNSFIRILQLVWHTTVWYFSISNVKLQGQLDFRDFDYSGTSLKALSIHQVVSDVFGFPQSYIYEIFSNMNIKNFTVSGTRMVHMLCPSKISPFLHLDFSNNLLTDTVFENCGHLTELETLILQMNQLKELSKIAEMTTQMKSLQQLDISQNSVSYDEKKGDCSWTKSLLSLNMSSNILTDTIFRCLPPRIKVLDLHSNKIKSIPKQVVKLEALQELNVAFNSLTDLPGCGSFSSLSVLIIDHNSVSHPSADFFQSCQKMRSIKAGDNPFQCTCELGEFVKNIDQVSSEVLEGWPDSYKCDYPESYRGTLLKDFHMSELSCNIT

SEQ ID NO: 3055 - protein, 576 aa, synthetic construct
  REGION 1..576: note = TLR10 (Q9BXR5) SP+PP+ECD
MRLIRNIYIFCSIVMTAEGDAPELPEERELMTNCSNMSLRKVPADLTPATTTLDLSYNLLFQLQSSDFHSVSKLRVLILCHNRIQQLDLKTFEFNKELRYLDLSNNRLKSVTWYLLAGLRYLDLSFNDFDTMPICEEAGNMSHLEILGLSGAKIQKSDFQKIAHLHLNTVFLGFRTLPHYEEGSLPILNTTKLHIVLPMDTNFWVLLRDGIKTSKILEMTNIDGKSQFVSYEMQRNLSLENAKTSVLLLNKVDLLWDDLFLILQFVWHTSVEHFQIRNVTFGGKAYLDHNSFDYSNTVMRTIKLEHVHFRVFYIQQDKIYLLLTKMDIENLTISNAQMPHMLFPNYPTKFQYLNFANNILTDELFKRTIQLPHLKTLILNGNKLETLSLVSCFANNTPLEHLDLSQNLLQHKNDENCSWPETVVNMNLSYNKLSDSVFRCLPKSIQILDLNNNQIQTVPKETIHLMALRELNIAFNFLTDLPGCSHFSRLSVLNIEMNFILSPSLDFVQSCQEVKTLNAGRNPFRCTCELKNFIQLETYSEVMMVGWSDSYTCEYPLNLRGTRLKDVHLHELSCNT

SEQ ID NO: 3056 - protein, 588 aa, synthetic construct
  REGION 1..588: note = TLR2 (O60603) SP+PP+ECD
MPHTLWMVWVLGVIISLSKEESSNQASLSCDRNGICKGSSGSLNSIPSGLTEAVKSLDLSNNRITYISNSDLQRCVNLQALVLTSNGINTIEEDSFSSLGSLEHLDLSYNYLSNLSSSWFKPLSSLTFLNLLGNPYKTLGETSLFSHLTKLQILRVGNMDTFTKIQRKDFAGLTFLEELEIDASDLQSYEPKSLKSIQNVSHLILHMKQHILLLEIFVDVTSSVECLELRDTDLDTFHFSELSTGETNSLIKKFTFRNVKITDESLFQVMKLLNQISGLLELEFDDCTLNGVGNFRASDNDRVIDPGKVETLTIRRLHIPRFYLFYDLSTLYSLTERVKRITVENSKVFLVPCLLSQHLKSLEYLDLSENLMVEEYLKNSACEDAWPSLQTLILRQNHLASLEKTGETLLTLKNLTNIDISKNSFHSMPETCQWPEKMKYLNLSSTRIHSVTGCIPKTLEILDVSNNNLNLFSLNLPQLKELYISRNKLMTLPDASLLPMLLVLKISRNAITTFSKEQLDSFHTLKTLEAGGNNFICSCEFLSFTQEQQALAKVLIDWPANYLCDSPSHVRGQQVQDVRLSVSECHRT

SEQ ID NO: 3057 - protein, 704 aa, synthetic construct
  REGION 1..704: note = TLR3 (O15455) SP+PP+ECD
MRQTLPCIYFWGGLLPFGMLCASSTTKCTVSHEVADCSHLKLTQVPDDLPTNITVLNLTHNQLRRLPAANFTRYSQLTSLDVGFNTISKLEPELCQKLPMLKVLNLQHNELSQLSDKTFAFCTNLTELHLMSNSIQKIKNNPFVKQKNLITLDLSHNGLSSTKLGTQVQLENLQELLLSNNKIQALKSEELDIFANSSLKKLELSSNQIKEFSPGCFHAIGRLFGLFLNNVQLGPSLTEKLCLELANTSIRNLSLSNSQLSTTSNTTFLGLKWTNLTMLDLSYNNLNVVGNDSFAWLPQLEYFFLEYNNIQHLFSHSLHGLFNVRYLNLKRSFTKQSISLASLPKIDDFSFQWLKCLEHLNMEDNDIPGIKSNMFTGLINLKYLSLSNSFTSLRTLTNETFVSLAHSPLHILNLTKNKISKIESDAFSWLGHLEVLDLGLNEIGQELTGQEWRGLENIFEIYLSYNKYLQLTRNSFALVPSLQRLMLRRVALKNVDSSPSPFQPLRNLTILDLSNNNIANINDDMLEGLEKLEILDLQHNNLARLWKHANPGGPIYFLKGLSHLHILNLESNGFDEIPVEVFKDLFELKIIDLGLNNLNTLPASVFNNQVSLKSLNLQKNLITSVEKKVFGPAFRNLTELDMRFNPFDCTCESIAWFVNWINETHTNIPELSSHYLCNTPPHYHGFPVRLFDTSSCKDSAPFEL

SEQ ID NO: 3058 - protein, 631 aa, synthetic construct
  REGION 1..631: note = TLR4 (O00206) SP+PP+ECD
MMSASRLAGTLIPAMAFLSCVRPESWEPCVEVVPNITYQCMELNFYKIPDNLPFSTKNLDLSFNPLRHLGSYSFFSFPELQVLDLSRCEIQTIEDGAYQSLSHLSTLILTGNPIQSLALGAFSGLSSLQKLVAVETNLASLENFPIGHLKTLKELNVAHNLIQSFKLPEYFSNLTNLEHLDLSSNKIQSIYCTDLRVLHQMPLLNLSLDLSLNPMNFIQPGAFKEIRLHKLTLRNNFDSLNVMKTCIQGLAGLEVHRLVLGEFRNEGNLEKFDKSALEGLCNLTIEEFRLAYLDYYLDDIIDLFNCLTNVSSFSLVSVTIERVKDFSYNFGWQHLELVNCKFGQFPTLKLKSLKRLTFTSNKGGNAFSEVDLPSLEFLDLSRNGLSFKGCCSQSDFGTTSLKYLDLSFNGVITMSSNFLGLEQLEHLDFQHSNLKQMSEFSVFLSLRNLIYLDISHTHTRVAFNGIFNGLSSLEVLKMAGNSFQENFLPDIFTELRNLTFLDLSQCQLEQLSPTAFNSLSSLQVLNMSHNNFFSLDTFPYKCLNSLQVLDYSLNHIMTSKKQELQHFPSSLAFLNLTQNDFACTCEHQSFLQWIKDQRQLLVEVERMECATPSDKQGMPVLSLNITCQMNK

SEQ ID NO: 3059 - protein, 639 aa, synthetic construct
  REGION 1..639: note = TLR5 (O60602) SP+PP+ECD
MGDHLDLLLGVVLMAGPVFGIPSCSFDGRIAFYRFCNLTQVPQVLNTTERLLLSFNYIRTVTASSFPFLEQLQLLELGSQYTPLTIDKEAFRNLPNLRILDLGSSKIYFLHPDAFQGLFHLFELRLYFCGLSDAVLKDGYFRNLKALTRLDLSKNQIRSLYLHPSFGKLNSLKSIDFSSNQIFLVCEHELEPLQGKTLSFFSLAANSLYSRVSVDWGKCMNPFRNMVLEILDVSGNGWTVDITGNFSNAISKSQAFSLILAHHIMGAGFGFHNIKDPDQNTFAGLARSSVRHLDLSHGFVFSLNSRVFETLKDLKVLNLAYNKINKIADEAFYGLDNLQVLNLSYNLLGELYSSNFYGLPKVAYIDLQKNHIAIIQDQTFKFLEKLQTLDLRDNALTTIHFIPSIPDIFLSGNKLVTLPKINLTANLIHLSENRLENLDILYFLLRVPHLQILILNQNRFSSCSGDQTPSENPSLEQLFLGENMLQLAWETELCWDVFEGLSHLQVLYLNHNYLNSLPPGVFSHLTALRGLSLNSNRLTVLSHNDLPANLEILDISRNQLLAPNPDVFVSLSVLDITHNKFICECELSTFINWLNHTNVTIAGPPADIYCVYPDSFSGVSLFSLSTEGCDEEEVLKSLK

SEQ ID NO: 3060 - protein, 586 aa, synthetic construct
  REGION 1..586: note = TLR6 (Q9Y2C9) SP+PP+ECD
MTKDKEPIVKSFHFVCLMIIIVGTRIQFSDGNEFAVDKSKRGLIHVPKDLPLKTKVLDMSQNYIAELQVSDMSFLSELTVLRLSHNRIQLLDLSVFKFNQDLEYLDLSHNQLQKISCHPIVSFRHLDLSFNDFKALPICKEFGNLSQLNFLGLSAMKLQKLDLLPIAHLHLSYILLDLRNYYIKENETESLQILNAKTLHLVFHPTSLFAIQVNISVNTLGCLQLTNIKLNDDNCQVFIKFLSELTRGSTLLNFTLNHIETTWKCLVRVFQFLWPKPVEYLNIYNLTIIESIREEDFTYSKTTLKALTIEHITNQVFLFSQTALYTVFSEMNIMMLTISDTPFIHMLCPHAPSTFKFLNFTQNVFTDSIFEKCSTLVKLETLILQKNGLKDLFKVGLMTKDMPSLEILDVSWNSLESGRHKENCTWVESIVVLNLSSNMLTDSVFRCLPPRIKVLDLHSNKIKSVPKQVVKLEALQELNVAFNSLTDLPGCGSFSSLSVLIIDHNSVSHPSADFFQSCQKMRSIKAGDNPFQCTCELREFVKNIDQVSSEVLEGWPDSYKCDYPESYRGSPLKDFHMSELSCNITL

SEQ ID NO: 3061 - protein, 839 aa, synthetic construct
  REGION 1..839: note = TLR7 (Q9NYK1) SP+PP+ECD
MVFPMWTLKRQILILFNIILISKLLGARWFPKTLPCDVTLDVPKNHVIVDCTDKHLTEIPGGIPTNTTNLTLTINHIPDISPASFHRLDHLVEIDFRCNCVPIPLGSKNNMCIKRLQIKPRSFSGLTYLKSLYLDGNQLLEIPQGLPPSLQLLSLEANNIFSIRKENLTELANIEILYLGQNCYYRNPCYVSYSIEKDAFLNLTKLKVLSLKDNNVTAVPTVLPSTLTELYLYNNMIAKIQEDDFNNLNQLQILDLSGNCPRCYNAPFPCAPCKNNSPLQIPVNAFDALTELKVLRLHSNSLQHVPPRWFKNINKLQELDLSQNFLAKEIGDAKFLHFLPSLIQLDLSFNFELQVYRASMNLSQAFSSLKSLKILRIRGYVFKELKSFNLSPLHNLQNLEVLDLGTNFIKIANLSMFKQFKRLKVIDLSVNKISPSGDSSEVGFCSNARTSVESYEPQVLEQLHYFRYDKYARSCRFKNKEASFMSVNESCYKYGQTLDLSKNSIFFVKSSDFQHLSFLKCLNLSGNLISQTLNGSEFQPLAELRYLDFSNNRLDLLHSTAFEELHKLEVLDISSNSHYFQSEGITHMLNFTKNLKVLQKLMMNDNDISSSTSRTMESESLRTLEFRGNHLDVLWREGDNRYLQLFKNLLKLEELDISKNSLSFLPSGVFDGMPPNLKNLSLAKNGLKSFSWKKLQCLKNLETLDLSHNQLTTVPERLSNCSRSLKNLILKNNQIRSLTKYFLQDAFQLRYLDLSSNKIQMIQKTSFPENVLNNLKMLLLHHNRFLCTCDAVWFVWWVNHTEVTIPYLATDVTCVGPGAHKGQSVISLDLYTCELDLTN

SEQ ID NO: 3062 - protein, 827 aa, synthetic construct
  REGION 1..827: note = TLR8 (Q9NR97) SP+PP+ECD
MENMFLQSSMLTCIFLLISGSCELCAEENFSRSYPCDEKKQNDSVIAECSNRRLQEVPQTVGKYVTELDLSDNFITHITNESFQGLQNLTKINLNHNPNVQHQNGNPGIQSNGLNITDGAFLNLKNLRELLLEDNQLPQIPSGLPESLTELSLIQNNIYNITKEGISRLINLKNLYLAWNCYFNKVCEKTNIEDGVFETLTNLELLSLSFNSLSHVPPKLPSSLRKLFLSNTQIKYISEEDFKGLINLTLLDLSGNCPRCFNAPFPCVPCDGGASINIDRFAFQNLTQLRYLNLSSTSLRKINAAWFKNMPHLKVLDLEFNYLVGEIASGAFLTMLPRLEILDLSFNYIKGSYPQHINISRNFSKLLSLRALHLRGYVFQELREDDFQPLMQLPNLSTINLGINFIKQIDFKLFQNFSNLEIIYLSENRISPLVKDTRQSYANSSSFQRHIRKRRSTDFEFDPHSNFYHFTRPLIKPQCAAYGKALDLSLNSIFFIGPNQFENLPDIACLNLSANSNAQVLSGTEFSAIPHVKYLDLTNNRLDFDNASALTELSDLEVLDLSYNSHYFRIAGVTHHLEFIQNFTNLKVLNLSHNNIYTLTDKYNLESKSLVELVFSGNRLDILWNDDDNRYISIFKGLKNLTRLDLSLNRLKHIPNEAFLNLPASLTELHINDNMLKFFNWTLLQQFPRLELLDLRGNKLLFLTDSLSDFTSSLRTLLLSHNRISHLPSGFLSEVSSLKHLDLSSNLLKTINKSALETKTTTKLSMLELHGNPFECTCDIGDFRRWMDEHLNVKIPRLVDVICASPGDQRGKSIVSLELTTCVSDVT

SEQ ID NO: 3063 - protein, 818 aa, synthetic construct
  REGION 1..818: note = TLR9 (Q9NR96) SP+PP+ECD
MGFCRSALHPLSLLVQAIMLAMTLALGTLPAFLPCELQPHGLVNCNWLFLKSVPHFSMAAPRGNVTSLSLSSNRIHHLHDSDFAHLPSLRHLNLKWNCPPVGLSPMHFPCHMTIEPSTFLAVPTLEELNLSYNNIMTVPALPKSLISLSLSHTNILMLDSASLAGLHALRFLFMDGNCYYKNPCRQALEVAPGALLGLGNLTHLSLKYNNLTVVPRNLPSSLEYLLLSYNRIVKLAPEDLANLTALRVLDVGGNCRRCDHAPNPCMECPRHFPQLHPDTFSHLSRLEGLVLKDSSLSWLNASWFRGLGNLRVLDLSENFLYKCITKTKAFQGLTQLRKLNLSFNYQKRVSFAHLSLAPSFGSLVALKELDMHGIFFRSLDETTLRPLARLPMLQTLRLQMNFINQAQLGIFRAFPGLRYVDLSDNRISGASELTATMGEADGGEKVWLQPGDLAPAPVDTPSSEDFRPNCSTLNFTLDLSRNNLVTVQPEMFAQLSHLQCLRLSHNCISQAVNGSQFLPLTGLQVLDLSHNKLDLYHEHSFTELPRLEALDLSYNSQPFGMQGVGHNFSFVAHLRTLRHLSLAHNNIHSQVSQQLCSTSLRALDFSGNALGHMWAEGDLYLHFFQGLSGLIWLDLSQNRLHTLLPQTLRNLPKSLQVLRLRDNYLAFFKWWSLHFLPKLEVLDLAGNQLKALTNGSLPAGTRLRRLDVSCNSISFVAPGFFSKAKELRELNLSANALKTVDHSWFGPLASALQILDVSANPLHCACGAAFMDFLLEVQAAVPGLPSRVKCGSPGQLQGLSIFAQDLRLCLDEALSWDC

SEQ ID NO: 3064 - protein, 187 aa, synthetic construct
  REGION 1..187: note = TMED7 (Q9Y3B3) SP+PP+ECD
MPRPGSAQRWAAVAGRWGCRLLALLLLVPGPGGASEITFELPDNAKQCFYEDIAQGTKCTLEFQVITGGHYDVDCRLEDPDGKVLYKEMKKQYDSFTFTASKNGTYKFCFSNEFSTFTHKTVYFDFQVGEDPPLFPSENRVSALTQMESACVSIHEALKSVIDYQTHFRLREAQGRSRAEDLNTRVA

SEQ ID NO: 3065 - protein, 330 aa, synthetic construct
  REGION 1..330: note = TMEFF1 (Q8IYR6) SP+PP+ECD
MGAAAAEAPLRLPAAPPLAFCCYTSVLLLFAFSLPGSRASNQPPGGGGGSGGDCPGGKGKSINCSELNVRESDVRVCDESSCKYGGVCKEDGDGLKCACQFQCHTNYIPVCGSNGDTYQNECFLRRAACKHQKEITVIARGPCYSDNGSGSGEGEEEGSGAEVHRKHSKCGPCKYKAECDEDAENVGCVCNIDCSGYSFNPVCASDGSSYNNPCFVREASCIKQEQIDIRHLGHCTDTDDTSLLGKKDDGLQYRPDVKDASDQREDVYIGNHMPCPENLNGYCIHGKCEFIYSTQKASCRCESGYTGQHCEKTDFSILYVVPSRQKLTHV

SEQ ID NO: 3066 - protein, 320 aa, synthetic construct
  REGION 1..320: note = TMEFF2 (Q9UIK5) SP+PP+ECD
MVLWESPRQCSSWTLCEGFCWLLLLPVMLLIVARPVKLAAFPTSLSDCQTPTGWNCSGYDDRENDLFLCDTNTCKFDGECLRIGDTVTCVCQFKCNNDYVPVCGSNGESYQNECYLRQAACKQQSEILVVSEGSCATDAGSGSGDGVHEGSGETSQKETSTCDICQFGAECDEDAEDVWCVCNIDCSQTNFNPLCASDGKSYDNACQIKEASCQKQEKIEVMSLGRCQDNTTTTTKSEDGHYARTDYAENANKLEESAREHHIPCPEHYNGFCMHGKCEHSINMQEPSCRCDAGYTGQHCEKKDYSVLYVVPGPVRFQYV

SEQ ID NO: 3067 - protein, 468 aa, synthetic construct
  REGION 1..468: note = TMEM108 (Q6UXF1) SP+PP+ECD
MKRSLQALYCQLLSFLLILALTEALAFAIQEPSPRESLQVLPSGTPPGTMVTAPHSSTRHTSVVMLTPNPDGPPSQAAAPMATPTPRAEGHPPTHTISTIAATVTAPHSESSLSTGPAPAAMATTSSKPEGRPRGQAAPTILLTKPPGATSRPTTAPPRTTTRRPPRPPGSSRKGAGNSSRPVPPAPGGHSRSKEGQRGRNPSSTPLGQKRPLGKIFQIYKGNFTGSVEPEPSTLTPRTPLWGYSSSPQPQTVAATTVPSNTSWAPTTTSLGPAKDKPGLRRAAQGGGSTFTSQGGTPDATAASGAPVSPQAAPVPSQRPHHGDPQDGPSHSDSWLTVTPGTSRPLSTSSGVFTAATGPTPAAFDTSVSAPSQGIPQGASTTPQAPTHPSRVSESTISGAKEETVATLTMTDRVPSPLSTVVSTATGNFLNRLVPAGTWKPGTAGNISHVAEGDKPQHRATICLSKMD

SEQ ID NO: 3068 - protein, 166 aa, synthetic construct
  REGION 1..166: note = TMEM123 (Q8N131) SP+PP+ECD
MGLGARGAWAALLLGTLQVLALLGAAHESAAMAASANIENSGLPHNSSANSTETLQHVPSDHTNETSNSTVKPPTSVASDSSNTTVTTMKPTAASNTTTPGMVSTNMTSTTLKSTPKTTSVSQNTSQISTSTMTVTHNSSVTSAASSVTITTTMHSEAKKGSKFDT

SEQ ID NO: 3069 - protein, 852 aa, synthetic construct
  REGION 1..852: note = TMEM132A (Q24JP5) SP+PP+ECD
MCARMAGRTTAAPRGPYGPWLCLLVALALDVVRVDCGQAPLDPVYLPAALELLDAPEHFRVQQVGHYPPANSSLSSRSETFLLLQPWPRAQPLLRASYPPFATQQVVPPRVTEPHQRPVPWDVRAVSVEAAVTPAEPYARVLFHLKGQDWPPGSGSLPCARLHATHPAGTAHQACRFQPSLGACVVELELPSHWFSQASTTRAELAYTLEPAAEGPGGCGSGEENDPGEQALPVGGVELRPADPPQYQEVPLDEAVTLRVPDMPVRPGQLFSATLLLRHNFTASLLTLRIKVKKGLHVTAARPAQPTLWTAKLDRFKGSRHHTTLITCHRAGLTEPDSSPLELSEFLWVDFVVENSTGGGVAVTRPVTWQLEYPGQAPEAEKDKMVWEILVSERDIRALIPLAKAEELVNTAPLTGVPQHVPVRLVTVDGGGALVEVTEHVGCESANTQVLQVSEACDAVFVAGKESRGARGVRVDFWWRRLRASLRLTVWAPLLPLRIELTDTTLEQVRGWRVPGPAEGPAEPAAEASDEAERRARGCHLQYQRAGVRFLAPFAAHPLDGGRRLTHLLGPDWLLDVSHLVAPHARVLDSRVASLEGGRVVVGREPGVTSIEVRSPLSDSILGEQALAVTDDKVSVLELRVQPVMGISLTLSRGTAHPGEVTATCWAQSALPAPKQEVALSLWLSFSDHTVAPAELYDRRDLGLSVSAEEPGAILPAEEQGAQLGVVVSGAGAEGLPLHVALHPPEPCRRGRHRVPLASGTAWLGLPPASTPAPALPSSPAWSPPATEATMGGKRQVAGSVGGNTGVRGKFERAEEEARKEETEAREEEEEEEEEMVPAPQHVTELELGMYA

SEQ ID NO: 3070 - protein, 922 aa, synthetic construct
  REGION 1..922: note = TMEM132C (Q8N3T6) SP+PP+ECD
MRSEGAAPGPAAPLCGALSLLLGALLGKVIEGHGVTDNIQRFSSLPPYLPVSYHILRAETSFFLKEANQDLLRNSSLQARVESFFTYKTRQPPVLNASYGPFSVEKVVPLDLMLTSNFLGPTNKFSFDWKLKAHILRDKVYLSRPKVQVLFHIMGRDWDDHGAGEKLPCLRVFAFRETREVRGSCRLKGDLGLCVAELELLSSWFSAPTVGAGRKKSMDQPEGTPVELYYTVHPGNERGDCAGGDFRKGNAIRPGKDGLEETTSHLQRIGTVGLYRAQDSAQLSELRLDGNVVIWLPSRPVKQGEVVTAYVTISSNSSVDLFILRAKVKKGVNILSAQTREPRQWGVKQEVGSGGKHVTATVACQRLGPSPRNRSSSLFNEVVQMNFEIASFSSLSGTQPITWQVEYPRKGTTDIAVSEIFVSQKDLVGIVPLAMDTEILNTAVLTGKTVAMPIKVVSVEENSAVMDISESVECKSTDEDVIKVSERCDYIFVNGKEIKGKMDAVVNFTYQYLSAPLCVTVWVPRLPLQIEVSDTELSQIKGWRVPIVTNKRPTRESEDEDEEERRGRGCALQYQHATVRVLTQFVSEGAGPWGQPNYLLSPNWQFDITHLVADFMKLEEPHVATLQDSRVLVGREVGMTTIQVLSPLSDSILAEKTITVLDDKVSVTDLAIQLVAGLSVALYPNAENSKAVTAVVTAEEVLRTPKQEAVFSTWLQFSDGSVTPLDIYDTKDFSLAATSQDEAVVSVPQPRSPRWPVVVAEGEGQGPLIRVDMTIAEACQKSKRKSILAVGVGNVRVKFGQNDADSSPGGDYEEDEIKNHASDRRQKGQHHERTGQDGHLYGSSPVEREEGALRRATTTARSLLDNKVVKNSRADGGRLAGEGQLQNIPIDFTNFPAHVDLPKAGSGLEENDLVQTPRGLSD

SEQ ID NO: 3071 - protein, 915 aa, synthetic construct
  REGION 1..915: note = TMEM132D (Q14C87) SP+PP+ECD
MCPSEMGTLWHHWSPVLISLAALFSKVTEGRGILESIQRFSLLPTYLPVTYHINNADVSFFLKEANQDIMRNSSLQSRVESFLIYKSRRLPVLNASYGPFSIEQVVPQDLMLPSNPFGFTNKFSLNWKLKAHILRDKVYLSRPKVQVLFHIMGRDWDDRSAGEKLPCLRVFAFRETREVRGSCRLQGDLGLCVAELELLSSWFSPPTVVAGRRKSVDQPEGTPVELYYTVHPGGERGDCVREDARRSNGIRTGHSDIDESGPPLQRIGSIFLYQTHRKPSLRELRLDNSVAIHYIPKTVRKGDVLTFPVSISRNSTEDRFTLRAKVKKGVNIIGVRASSPSIWDVKERTDYTGKYAPAVIVCQKKAAGSENSADGASYEVMQIDVEVEEPGDLPATQLVTWQVEYPGEITSDLGVSKIYVSPKDLIGVVPLAMEAEILNTAILTGKTVAVPVKVVSVEDDGTVTELLESVECRSSDEDVIKVSDRCDYVFVNGKEMKGKVNVVVNFTYQHLSSPLEMTVWVPRLPLQIEVSDTELNQIKGWRVPIVSSRRPAGDSEEEEDDERRGRGCTLQYQHAMVRVLTQFVAEAAGPGGHLAHLLGSDWQVDITELINDFMQVEEPRIAKLQGGQILMGQELGMTTIQILSPLSDTILAEKTITVLDEKVTITDLGVQLVTGLSLSLQLSPGSNRAIFATAVAQELLQRPKQEAAISCWVQFSDGSVTPLDIYDGKDFSLMATSLDEKVVSIHQDPKFKWPIIAAETEGQGTLVKVEMVISESCQKSKRKSVLAVGTANIKVKFGQNDANPNTSDSRHTGAGVHMENNVSDRRPKKPSQEWGSQEGQYYGSSSMGLMEGRGTTTDRSILQKKKGQESLLDDNSHLQTIPSDLTSFPAQVDLPRSNGEMDGNDLMQASKGLSD

SEQ ID NO: 3072 - protein, 893 aa, synthetic construct
  REGION 1..893: note = TMEM132E (Q6IEE7) SP+PP+ECD
MAPGMSGRGGAALLCLSALLAHASGRSHPASPSPPGPQASPVLPVSYRLSHTRLAFFLREARPPSPAVANSSLQRSEPFVVFQTKELPVLNVSLGPFSTSQVVARELLQPSSTLDIPERLTVNWKVRAFIVRSHVPASQPVVQVLFYVAGRDWDDFGVTERLPCVRLHAFRDAREVKSSCRLSGGLATCLVRAELPLAWFGPPAPAAPPTARRKSPDGLEPEATGESQQAELYYTLHAPDASGGCGGSRRGAGPGVGARAESPTQHPLLRIGSISLFRPPPRRTLQEHRLDSNLMIRLPDRPLKPGEVLSILLYLAPNSSSPSSPSVEHFTLRVKAKKGVTLLGTKSRSGQWHVTSELLTGAKHSTATVDVAWAQSTPLPPREGQGPLEILQLDFEMENFTSQSVKRRIMWHIDYRGHGALPDLERAVTELTVIQRDVQAILPLAMDTEIINTAILTGRTVAIPVKVIAIEVNGLVLDISALVECESDNEDIIKVSSSCDYVFVSGKESRGSMNARVTFRYDVLNAPLEMTVWVPKLPLHIELSDARLSQVKGWRVPILPDRRSVRESEDEDEEEEERRQSASRGCTLQYQHATLQVFTQFHTTSSEGTDQVVTMLGPDWLVEVTDLVSDFMRVGDPRVAHMVDSSTLAGLEPGTTPFKVVSPLTEAVLGETLLTVTEEKVSITQLQAQVVASLALSLRPSPGSSHTILATTAAQQTLSFLKQEALLSLWLSYSDGTTAPLSLYSPRDYGLLVSSLDEHVATVTQDRAFPLVVAEAEGSGELLRAELTIAESCQKTKRKSVLATTPVGLRVHFGRDEEDPTYDYPGPSQPGPGGGEDEARGAGPPGSALPAPEAPGPGTASPVVPPTEDFLPLPTGFLQVPRGLTDLEIGMYA

SEQ ID NO: 3073 - protein, 75 aa, synthetic construct
  REGION 1..75: note = TMEM154 (Q6P9G4) SP+PP+ECD
MQAPRAALVFALVIALVPVGRGNYEELENSGDTTVESERPNKVTIPSTFAAVTIKETLNANINSTNFAPDENQLE

SEQ ID NO: 3074 - protein, 230 aa, synthetic construct
  REGION 1..230: note = TMEM158 (Q8WZ71) SP+PP+ECD
MLPLLAALLAAACPLPPVRGGAADAPGLLGVPSNASVNASSADEPIAPRLLASAAPGPPERPGPEEAAAAAAPCNISVQRQMLSSLLVRWGRPRGFQCDLLLFSTNAHGRAFFAAAFHRVGPPLLIEHLGLAAGGAQQDLRLCVGCGWVRGRRTGRLRPAAAPSAAAATAGAPTALPAYPAAEPPGPLWLQGEPLHFCCLDFSLEELQGEPGWRLNRKPIESTLVACFMT

SEQ ID NO: 3075 - protein, 70 aa, synthetic construct
  REGION 1..70: note = TMEM213 (A2RRL7) SP+PP+ECD
MQRLPAATRATLILSLAFASLHSACSAEASSSNSSSLTAHHPDPGTLEQCLNVDFCPQAARCCRTGVDEY

SEQ ID NO: 3076 - protein, 204 aa, synthetic construct
  REGION 1..204: note = TMEM219 (Q86XT9) SP+PP+ECD
MGNCQAGHNLHLCLAHHPPLVCATLILLLLGLSGLGLGSFLLTHRTGLRSPDIPQDWVSFLRSFGQLTLCPRNGTVTGKWRGSHVVGLLTTLNFGDGPDRNKTRTFQATVLGSQMGLKGSSAGQLVLITARVTTERTAGTCLYFSAVPGILPSSQPPISCSEEGAGNATLSPRMGEECVSVWSHEGLVLTKLLTSEELALCGSR

SEQ ID NO: 3077 - protein, 232 aa, synthetic construct
  REGION 1..232: note = TMEM25 (Q86YD3) SP+PP+ECD
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGLLATRVE

SEQ ID NO: 3078 - protein, 141 aa, synthetic construct
  REGION 1..141: note = TMEM27 (Q9HBJ8) SP+PP+ECD
MLWLLFFLVTAIHAELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNDQTLEFLKIPSTLAPPMDPSVP

SEQ ID NO: 3079 - protein, 89 aa, synthetic construct
  REGION 1..89: note = TMEM9 (Q9P0T7) SP+PP+ECD
MKLLSLVAVVGCLLVPPAEANKSSEDIRCKCICPPYRNISGHIYNQNVSQKDCNCLHVVEPMPVPGHDVEAYCLLCECRYEERSTTTIK

SEQ ID NO: 3080 - protein, 145 aa, synthetic construct
  REGION 1..145: note = TMEM95 (Q3KNT9) SP+PP+ECD
MWRLALGGVFLAAAQACVFCRLPAHDLSGRLARLCSQMEARQKECGASPDFSAFALDEVSMNKVTEKTHRVLRVMEIKEAVSSLPSYWSWLRKTKLPEYTREALCPPACRGSTTLYNCSTCKGTEVSCWPRKRCFPGSQDLWEAK

SEQ ID NO: 3081 - protein, 104 aa, synthetic construct
  REGION 1..104: note = TMEM9B (Q9NQ34) SP+PP+ECD
MATLWGGLLRLGSLLSLSCLALSVLLLAQLSDAAKNFEDVRCKCICPPYKENSGHIYNKNISQKDCDCLHVVEPMPVRGPDVEAYCLRCECKYEERSSVTIKVT

SEQ ID NO: 3082 - protein, 220 aa, synthetic construct
  REGION 1..220: note = TMIGD1 (Q6UXZ0) SP+PP+ECD
MAWKSSVIMQMGRFLLLVILFLPREMTSSVLTVNGKTENYILDTTPGSQASLICAVQNHTREEELLWYREEGRVDLKSGNKINSSSVCVSSISENDNGISFTCRLGRDQSVSVSVVLNVTFPPLLSGNDFQTVEEGSNVKLVCNVKANPQAQMMWYKNSSLLDLEKSRHQIQQTSESFQLSITKVEKPDNGTYSCIAKSSLKTESLDFHLIVKDKTVGVP

SEQ ID NO: 3083 - protein, 150 aa, synthetic construct
  REGION 1..150: note = TMIGD2 (Q96BF3) SP+PP+ECD
MGSPGMVLGLLVQIWALQEASSLSVQQGPNLLQVRQGSQATLVCQVDQATAWERLRVKWTKDGAILCQPYITNGSLSLGVCGPQGRLSWQAPSHLTLQLDPVSLNHSGAYVCWAAVEIPELEEAEGNITRLFVDPDDPTQNRNRIASFPG

SEQ ID NO: 3084 - protein, 375 aa, synthetic construct
  REGION 1..375: note = TMX3 (Q96JJ7) SP+PP+ECD
MAAWKSWTALRLCATVVVLDMVVCKGFVEDLDESFKENRNDDIWLVDFYAPWCGHCKKLEPIWNEVGLEMKSIGSPVKVGKMDATSYSSIASEFGVRGYPTIKLLKGDLAYNYRGPRTKDDIIEFAHRVSGALIRPLPSQQMFEHMQKRHRVFFVYVGGESPLKEKYIDAASELIVYTYFFSASEEVVPEYVTLKEMPAVLVFKDETYFVYDEYEDGDLSSWINRERFQNYLAMDGFLLYELGDTGKLVALAVIDEKNTSVEHTRLKSIIQEVARDYRDLFHRDFQFGHMDGNDYINTLLMDELTVPTVVVLNTSNQQYFLLDRQIKNVEDMVQFINNILDGTVEAQGGDSILQRLKRIVFDAKSTIVSIFKSSP

SEQ ID NO: 3085 - protein, 189 aa, synthetic construct
  REGION 1..189: note = TMX4 (Q9H1E5) SP+PP+ECD
MAGGRCGPQLTALLAAWIAAVAATAGPEEAALPPEQSRVQPMTASNWTLVMEGEWMLKFYAPWCPSCQQTDSEWEAFAKNGEILQISVGKVDVIQEPGLSGRFFVTTLPAFFHAKDGIFRRYRGPGIFEDLQNYILEKKWQSVEPLTGWKSPASLTMSGMAGLFSISGKIWHLHNYFTVTLGIPAWCSY

SEQ ID NO: 3086 - protein, 239 aa, synthetic construct
  REGION 1..239: note = TNFRSF10A (O00220) SP+PP+ECD
MAPPPARVHLGAFLAVTPNPGSAASGTEAAAATPSKVWGSSAGRIEPRGGGRGALPTSMGQHGPSARARAGRAPGPRPAREASPRLRVHKTFKFVVVGVLLQVVPSSAATIKLHDQSIGTQQWEHSPLGELCPPGSHRSEHPGACNRCTEGVGYTNASNNLFACLPCTACKSDEEERSPCTTTRNTACQCKPGTFRNDNSAEMCRKCSRGCPRGMVKVKDCTPWSDIECVHKESGNGHN

SEQ ID NO: 3087 - protein, 211 aa, synthetic construct
  REGION 1..211: note = TNFRSF10D (Q9UBN6) SP+PP+ECD
MGLWGQSVPTASSARAGRYPGARTASGTRPWLLDPKILKFVVFIVAVLLPVRVDSATIPRQDEVPQQTVAPQQQRRSLKEEECPAGSHRSEYTGACNPCTEGVDYTIASNNLPSCLLCTVCKSGQTNKSSCTTTRDTVCQCEKGSFQDKNSPEMCRTCRTGCPRGMVKVSNCTPRSDIKCKNESAASSTGKTPAAEETVTTILGMLASPYH

SEQ ID NO: 3088 - protein, 212 aa, synthetic construct
  REGION 1..212: note = TNFRSF11A (Q9Y6Q6) SP+PP+ECD
MAPRARRRRPLFALLLLCALLARLQVALQIAPPCTSEKHYEHLGRCCNKCEPGKYMSSKCTTTSDSVCLPCGPDEYLDSWNEEDKCLLHKVCDTGKALVAVVAGNSTTPRRCACTAGYHWSQDCECCRRNTECAPGLGAQHPLQLNKDTVCKPCLAGYFSDAFSSTDKCRPWTNCTFLGKRVEHHGTEKSDAVCSSSLPARKPPNEPHVYLP

SEQ ID NO: 3089 - protein, 202 aa, synthetic construct
  REGION 1..202: note = TNFRSF14 (Q92956) SP+PP+ECD
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHWV

SEQ ID NO: 3090 - protein, 162 aa, synthetic construct
  REGION 1..162: note = TNFRSF18 (Q9Y5U5) SP+PP+ECD
MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEP

SEQ ID NO: 3091 - protein, 170 aa, synthetic construct
  REGION 1..170: note = TNFRSF19 (Q9NS68) SP+PP+ECD
MALKVLLEQEKTFFTLLVLLGYLSCKVTCESGDCRQQEFRDRSGNCVPCNQCGPGMELSKECGFGYGEDAQCVTCRLHRFKEDWGFQKCKPCLDCAVVNRFQKANCSATSDAICGDCLPGFYRKTKLVGFQDMECVPCGDPPPPYEPHCASKVNLVKIASTASSPRDTAL

SEQ ID NO: 3092 - protein, 211 aa, synthetic construct
  REGION 1..211: note = TNFRSF1A (P19438) SP+PP+ECD
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTT

SEQ ID NO: 3093 - protein, 257 aa, synthetic construct
  REGION 1..257: note = TNFRSF1B (P20333) SP+PP+ECD
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGD

SEQ ID NO: 3094 - protein, 349 aa, synthetic construct
  REGION 1..349: note = TNFRSF21 (O75509) SP+PP+ECD
MGTSPSSSTALASCSRIARRATATMIAGSLLLLGFLSTTTAQPEQKASNLIGTYRHVDRATGQVLTCDKCPAGTYVSEHCTNTSLRVCSSCPVGTFTRHENGIEKCHDCSQPCPWPMIEKLPCAALTDRECTCPPGMFQSNATCAPHTVCPVGWGVRKKGTETEDVRCKQCARGTFSDVPSSVMKCKAYTDCLSQNLVVIKPGTKETDNVCGTLPSFSSSTSPSPGTAIFPRPEHMETHEVPSSTYVPKGMNSTESNSSASVRPKVLSSIQEGTVPDNTSSARGKEDVNKTLPNLQVVNHQQGPHHRHILKLLPSMEATGGEKSSTPIKGPKRGHPRQNLHKHFDINEH

SEQ ID NO: 3095 - protein, 199 aa, synthetic construct
  REGION 1..199: note = TNFRSF25 (Q93038) SP+PP+ECD
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQ

SEQ ID NO: 3096 - protein, 214 aa, synthetic construct
  REGION 1..214: note = TNFRSF4 (P43489) SP+PP+ECD
MCVGARRLGRGPCAALLLLGLGLSTVTGLHCVGDTYPSNDRCCHECRPGNGMVSRCSRSQNTVCRPCGPGFYNDVVSSKPCKPCTWCNLRSGSERKQLCTATQDTVCRCRAGTQPLDSYKPGVDCAPCPPGHFSPGDNQACKPWTNCTLAGKHTLQPASNSSDAICEDRDPPATQPQETQGPPARPITVQPTEAWPRTSQGPSTRPVEVPGGRA

SEQ ID NO: 3097 - protein, 385 aa, synthetic construct
  REGION 1..385: note = TNFRSF8 (P28908) SP+PP+ECD
MRVLLAALGLLFLGALRAFPQDRPFEDTCHGNPSHYYDKAVRRCCYRCPMGLFPTQQCPQRPTDCRKQCEPDYYLDEADRCTACVTCSRDDLVEKTPCAWNSSRVCECRPGMFCSTSAVNSCARCFFHSVCPAGMIVKFPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSCARCVPYPICAAETVTKPQDMAEKDTTFEAPPLGTQPDCNPTPENGEAPASTSPTQSLLVDSQASKTLPIPTSAPVALSSTGKPVLDAG

SEQ ID NO: 3098 - protein, 186 aa, synthetic construct
  REGION 1..186: note = TNFRSF9 (Q07011) SP+PP+ECD
MGNSCYNIVATLLLVLNFERTRSLQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQ

SEQ ID NO: 3099 - protein, 309 aa, synthetic construct
  REGION 1..309: note = TP53I13 (Q8NBR0) SP+PP+ECD
MAPPPPSPQLLLLAALARLLGPSEVMAGPAEEAGAHCPESLWPLPPQVSPRVTYTRVSPGQAEDVTFLYHPCAHPWLKLQLALLAYACMANPSLTPDFSLTQDRPLVLTAWGLALEMAWVEPAWAAHWLMRRRRRKQRKKKAWIYCESLSGPAPSEPTPGRGRLCRRGCVQALALAFALRSWRPPGTEVTSQGPRQPSSSGAKRRRLRAALGPQPTRSALRFPSASPGSLKAKQSMAGIPGRESNAPSVPTVSLLPGAPGGNASSRTEAQVPNGQGSPGGCVCSSQASPAPRAAAPPRAARGPTPRTEE

SEQ ID NO: 3100 - protein, 355 aa, synthetic construct
  REGION 1..355: note = TPBG (Q13641) SP+PP+ECD
MPGGCSRGPAAGDGRLRLARLALVLLGWVSSSSPTSSASSFSSSAPFLASAVSAQPPLPDQCPALCECSEAARTVKCVNRNLTEVPTDLPAYVRNLFLTGNQLAVLPAGAFARRPPLAELAALNLSGSRLDEVRAGAFEHLPSLRQLDLSHNPLADLSPFAFSGSNASVSAPSPLVELILNHIVPPEDERQNRSFEGMVVAALLAGRALQGLRRLELASNHFLYLPRDVLAQLPSLRHLDLSNNSLVSLTYVSFRNLTHLESLHLEDNALKVLHNGTLAELQGLPHIRVFLDNNPWVCDCHMADMVTWLKETEVVQGKDRLTCAYPEKMRNRVLLELNSADLDCDPILPPSLQTS

SEQ ID NO: 3101 - protein, 307 aa, synthetic construct
  REGION 1..307: note = TPBGL (P0DKB5) SP+PP+ECD
MAPRAGQPGLQGLLLVAAALSQPAAPCPFQCYCFGGPKLLLRCASGAELRQPPRDVPPDARNLTIVGANLTVLRAAAFAGGDGDGDQAAGVRLPLLSALRLTHNHIEVVEDGAFDGLPSLAALDLSHNPLRALGGGAFRGLPALRSLQLNHALVRGGPALLAALDAALAPLAELRLLGLAGNALSRLPPAALRLARLEQLDVRLNALAGLDPDELRALERDGGLPGPRLLLADNPLRCGCAARPLLAWLRNATERVPDSRRLRCAAPRALLDRPLLDLDGARLRCADSGADARGEEAEAAGPELEAS

SEQ ID NO: 3102 - protein, 846 aa, synthetic construct
  REGION 1..846: note = TPO (P07202) SP+PP+ECD
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPR

SEQ ID NO: 3103 - protein, 283 aa, synthetic construct
  REGION 1..283: note = TPSG1 (Q9NRR2) SP+PP+ECD
MALGACGLLLLLAVPGVSLRTLQPGCGRPQVSDAGGRIVGGHAAPAGAWPWQASLRLRRMHVCGGSLLSPQWVLTAAHCFSGSLNSSDYQVHLGELEITLSPHFSTVRQIILHSSPSGQPGTSGDIALVELSVPVTLSSRILPVCLPEASDDFCPGIRCWVTGWGYTREGEPLPPPYSLREVKVSVVDTETCRRDYPGPGGSILQPDMLCARGPGDACQDDSGGPLVCQVNGAWVQAGTVSWGEGCGRPNRPGVYTRVPAYVNWIRRHITASGGSESGYPRLP

SEQ ID NO: 3104 - protein, 477 aa, synthetic construct
  REGION 1..477: note = TRABD2A (Q86V40) SP+PP+ECD
MSPWSWFLLQTLCLLPTGAASRRGAPGTANCELKPQQSELNSFLWTIKRDPPSYFFGTIHVPYTRVWDFIPDNSKEAFLQSSIVYFELDLTDPYTISALTSCQMLPQGENLQDVLPRDIYCRLKRHLEYVKLMMPLWMTPDQRGKGLYADYLFNAIAGNWERKRPVWVMLMVNSLTEVDIKSRGVPVLDLFLAQEAERLRKQTGAVEKVEEQCHPLNGLNFSQVIFALNQTLLQQESLRAGSLQIPYTTEDLIKHYNCGDLSSVILSHDSSQVPNFINATLPPQERITAQEIDSYLRRELIYKRNERIGKRVKALLEEFPDKGFFFAFGAGHFMGNNTVLDVLRREGYEVEHAPAGRPIHKGKSKKTSTRPTLSTIFAPKVPTLEVPAPEAVSSGHSTLPPLVSRPGSADTPSEAEQRFRKKRRRSQRRPRLRQFSDLWVRLEESDIVPQLQVPVLDRHISTELRLPRRGHSHHSQM

SEQ ID NO: 3105 - protein, 494 aa, synthetic construct
  REGION 1..494: note = TRABD2B (A6NFA1) SP+PP+ECD
MHAALAGPLLAALLATARARPQPPDGGQCRPPGSQRDLNSFLWTIRRDPPAYLFGTIHVPYTRVWDFIPDNSKAAFQASTRVYFELDLTDPYTISALASCQLLPHGENLQDVLPHELYWRLKRHLDYVKLMMPSWMTPAQRGKGLYADYLFNAIAGNWERKRPVWVMLMVNSLTERDVRFRGVPVLDLYLAQQAEKMKKTTGAVEQVEEQCHPLNNGLNFSQVLFALNQTLLQQESVRAGSLQASYTTEDLIKHYNCGDLSAVIFNHDTSQLPNFINTTLPPHEQVTAQEIDSYFRQELIYKRNERMGKRVMALLRENEDKICFFAFGAGHFLGNNTVIDILRQAGLEVDHTPAGQAIHSPAPQSPAPSPEGTSTSPAPVTPAAAVPEAPSVTPTAPPEDEDPALSPHLLLPDSLSQLEEFGRQRKWHKRQSTHQRPRQFNDLWVRIEDSTTASPPPLPLQPTHSSGTAKPPFQLSDQLQQQDPPGPASSSAPT

SEQ ID NO: 3106 - protein, 205 aa, synthetic construct
  REGION 1..205: note = TREM1 (Q9NP99) SP+PP+ECD
MRKTRLWGLLWMLFVSELRAATKLTEEKYELKEGQTLDVKCDYTLEKFASSQKAWQIIRDGEMPKTLACTERPSKNSHPVQVGRIILEDYHDHGLLRVRMVNLQVEDSGLYQCVIYQPPKEPHMLFDRIRLVVTKGFSGTPGSNENSTQNVYKIPPTTTKALCPLYTSPRTVTQAPPKSTADVSTPDSEINLTNVTDIIRVPVFN

SEQ ID NO: 3107 - protein, 174 aa, synthetic construct
  REGION 1..174: note = TREM2 (Q9NZC2) SP+PP+ECD
MEPLRLLILLFVTELSGAHNTTVFQGVAGQSLQVSCPYDSMKHWGRRKAWCRQLGEKGPCQRVVSTHNLWLLSFLRRWNGSTAITDDTLGGTLTITLRNLQPHDAGLYQCQSLHGSEADTLRKVLVEVLADPLDHRDAGDLWFPGESESFEDAHVEHSISRSLLEGEIPFPPTS

SEQ ID NO: 3108 - protein, 268 aa, synthetic construct
  REGION 1..268: note = TREML2 (Q5T2D2) SP+PP+ECD
MAPAFLLLLLLWPQGCVSGPSADSVYTKVRLLEGETLSVQCSYKGYKNRVEGKVWCKIRKKKCEPGFARVWVKGPRYLLQDDAQAKVVNITMVALKLQDSGRYWCMRNTSGILYPLMGFQLDVSPAPQTERNIPFTHLDNILKSGTVTTGQAPTSGPDAPFTTGVMVFTPGLITLPRLLASTRPASKTGYSFTATSTTSQGPRRTMGSQTVTASPSNARDSSAGPESISTKSGDLSTRSPTTGLCLTSRSLLNRLPSMPSIRHQDVYS

SEQ ID NO: 3109 - protein, 696 aa, synthetic construct
  REGION 1..696: note = TRIL (Q7L0X0) SP+PP+ECD
MEAARALRLLLVVCGCLALPPLAEPVCPERCDCQHPQHLLCTNRGLRVVPKTSSLPSPHDVLTYSLGGNFITNITAFDFHRLGQLRRLDLQYNQIRSLHPKTFEKLSRLEELYLGNNLLQALAPGTLAPLRKLRILYANGNEISRLSRGSFEGLESLVKLRLDGNALGALPDAVFAPLGNLLYLHLESNRIRFLGKNAFAQLGKLRFLNLSANELQPSLRHAATFAPLRSLSSLILSANNLQHLGPRIFQHLPRLGLLSLRGNQLTHLAPEAFWGLEALRELRLEGNRLSQLPTALLEPLHSLEALDLSGNELSALHPATFGHLGRLRELSLRNNALSALSGDIFAASPALYRLDLDGNGWTCDCRLRGLKRWMGDWHSQGRLLTVFVQCRHPPALRGKYLDYLDDQQLQNGSCADPSPSASLTADRRRQPLPTAAGEEMTPPAGLAEELPPQPQLQQQGRFLAGVAWDGAARELVGNRSALRLSRRGPGLQQPSPSVAAAAGPAPQSLDLHKKPQRGRPTRADPALAEPTPTASPGSAPSPAGDPWQRATKHRLGTEHQERAAQSDGGAGLPPLVSDPCDFNKFILCNLTVEAVGADSASVRWAVREHRSPRPLGGARFRLLFDRFGQQPKFHRFVYLPESSDSATLRELRGDTPYLVCVEGVLGGRVCPVAPRDHCAGLVTLPEAGSRGGVDYQ

SEQ ID NO: 3110 - protein, 321 aa, synthetic construct
  REGION 1..321: note = TXNDC15 (Q96J42) SP+PP+ECD
MVPAAGRRPPRVMRLLGWWQVLLWVLGLPVRGVEVAEESGRLWSEEQPAHPLQVGAVYLGEEELLHDPMGQDRAAEEANAVLGLDTQGDHMVMLSVIPGEAEDKVSSEPSGVTCGAGGAEDSRCNVRESLFSLDGAGAHFPDREEEYYTEPEVAESDAAPTEDSNNTESLKSPKVNCEERNITGLENFTLKILNMSQDLMDFLNPNGSDCTLVLFYTPWCRFSASLAPHFNSLPRAFPALHFLALDASQHSSLSTRFGTVAVPNILLFQGAKPMARFNHTDRTLETLKIFIFNQTGIEAKKNVVVTQADQIGPLPSTLIKS

SEQ ID NO: 3111 - protein, 476 aa, synthetic construct
  REGION 1..476: note = TYR (P14679) SP+PP+ECD
MLLAVLYCLLWSFQTSAGHFPRACVSSKNLMEKECCPPWSGDRSPCGQLSGRGSCQNILLSNAPLGPQFPFTGVDDRESWPSVFYNRTCQCSGNFMGFNCGNCKFGFWGPNCTERRLLVRRNIFDLSAPEKDKFFAYLTLAKHTISSDYVIPIGTYGQMKNGSTPMFNDINIYDLFVWMHYYVSMDALLGGSEIWRDIDFAHEAPAFLPWHRLFLLRWEQEIQKLTGDENFTIPYWDWRDAEKCDICTDEYMGGQHPTNPNLLSPASFFSSWQIVCSRLEEYNSHQSLCNGTPEGPLRRNPGNHDKSRTPRLPSSADVEFCLSLTQYESGSMDKAANFSFRNTLEGFASPLTGIADASQSSMHNALHIYMNGTMSQVQGSANDPIFLLHHAFVDSIFEQWLRRHRPLQEVYPEANAPIGHNRESYMVPFIPLYRNGDFFISSKDLGYDYSYLQDSDPDSFQDYIKSYLEQASRIWS

SEQ ID NO: 3112 - protein, 429 aa, synthetic construct
  REGION 1..429: note = TYRO3 (Q06418) SP+PP+ECD
MALRRSMGRPGLPPLPLPPPPRLGLLLAALASLLLPESAAAGLKLMGAPVKLTVSQGQPVKLNCSVEGMEEPDIQWVKDGAVVQNLDQLYIPVSEQHWIGFLSLKSVERSDAGRYWCQVEDGGETEISQPVWLTVEGVPFFTVEPKDLAVPPNAPFQLSCEAVGPPEPVTIVWWRGTTKIGGPAPSPSVLNVTGVTQSTMFSCEAHNLKGLASSRTATVHLQALPAAPFNITVTKLSSSNASVAWMPGADGRALLQSCTVQVTQAPGGWEVLAVVVPVPPFTCLLRDLVPATNYSLRVRCANALGPSPYADWVPFQTKGLAPASAPQNLHAIRTDSGLILEWEEVIPEAPLEGPLGPYKLSWVQDNGTQDELTVEGTRANLTGWDPQKDLIVRVCVSNAVGCGPWSQPLVVSSHDRAGQQGPPHSRTSW

SEQ ID NO: 3113 - protein, 477 aa, synthetic construct
  REGION 1..477: note = TYRP1 (P17643) SP+PP+ECD
MSAPKLLSLGCIFFPLLLFQQARAQFPRQCATVEALRSGMCCPDLSPVSGPGTDRCGSSSGRGRCEAVTADSRPHSPQYPHDGRDDREVWPLRFFNRTCHCNGNFSGHNCGTCRPGWRGAACDQRVLIVRRNLLDLSKEEKNHFVRALDMAKRTTHPLFVIATRRSEEILGPDGNTPQFENISIYNYFVWTHYYSVKKTFLGVGQESFGEVDFSHEGPAFLTWHRYHLLRLEKDMQEMLQEPSFSLPYWNFATGKNVCDICTDDLMGSRSNFDSTLISPNSVFSQWRVVCDSLEDYDTLGTLCNSTEDGPIRRNPAGNVARPMVQRLPEPQDVAQCLEVGLFDTPPFYSNSTNSFRNTVEGYSDPTGKYDPAVRSLHNLAHLFLNGTGGQTHLSPNDPIFVLLHTFTDAVFDEWLRRYNADISTFPLENAPIGHNRQYNMVPFWPPVTNTEMFVTAPDNLGYTYEIQWPSREFSVPE

SEQ ID NO: 3114 - protein, 471 aa, synthetic construct
  REGION 1..471: note = UGT8 (Q16880) SP+PP+ECD
MKSYTPYFILLWSAVGIAKAAKIIIVPPIMFESHMYIFKTLASALHERGHHTVFLLSEGRDIAPSNHYSLQRYPGIFNSTTSDAFLQSKMRNIFSGRLTAIELFDILDHYTKNCDLMVGNHALIQGLKKEKFDLLLVDPNDMCGFVIAHLLGVKYAVFSTGLWYPAEVGAPAPLAYVPEFNSLLTDRMNLLQRMKNTGVYLISRLGVSFLVLPKYERIMQKYNLLPEKSMYDLVHGSSLWMLCTDVALEFPRPTLPNVVYVGGILTKPASPLPEDLQRWVNGANEHGFVLVSFGAGVKYLSEDIANKLAGALGRLPQKVIWRFSGPKPKNLGNNTKLIEWLPQNDLLGHSKIKAFLSHGGLNSIFETIYHGVPVVGIPLFGDHYDTMTRVQAKGMGILLEWKTVTEKELYEALVKVINNPSYRQRAQKLSEIHKDQPGHPVNRTIYWIDYIIRHNGAHHLRAAVHQISFCQ

SEQ ID NO: 3115 - protein, 1272 aa, synthetic construct
  REGION 1..1272: note = UMODL1 (Q5DID0) SP+PP+ECD
MLRTSGLALLALVSAVGPSQASGFTEKGLSLLGYQLCSHRVTHTVQKVEAVQTSYTSYVSCGGWIPWRRCPKMVYRTQYLVVEVPESRNVTDCCEGYEQLGLYCVLPLNQSGQFTSRPGACPAEGPEPSTSPCSLDIDCPGLEKCCPWSGGRYCMAPAPQAPERDPVGSWYNVTILVKMDFKELQQVDPRLLNHMRLLHSLVTSALQPMASTVHHLHSAPGNASTTVSRLLLGLPRPLPVADVSTLLGDIAKRVYEVISVQVQDVNECFYEELNACSGRELCANLEGSYWCVCHQEAPATSPRKLNLEWEDCPPVSDYVVLNVTSDSFQVSWRLNSTQNHTFHVRVYRGMELLRSARTQSQALAVAGLEAGVLYRVKTSYQGCGADVSTTLTIKTNAQVFEVTIKIVNHNLTEKLLNRSSVEYQDFSRQLLHEVESSFPPVVSDLYRSGKLRMQIVSLQAGSVVVRLKLTVQDPGFPMGISTLAPILQPLLASTVFQIDRQGTRVQDWDECVDSAEHDCSPAAWCINLEGSYTCQCRTTRDATPSRAGRACEGDLVSPMGGGLSAATGVTVPGLGTGTAALGLENFTLSPSPGYPQGTPAAGQAWTPEPSPRRGGSNVVGYDRNNTGKGVEQELQGNSIMEPPSWPSPTEDPTGHFLWHATRSTRETLLNPTWLRNEDSGPSGSVDLPLTSTLTALKTPACVPVSIGRIMVSNVTSTGFHLAWEADLAMDSTFQLTLTSMWSPAVVLETWNTSVTLSGLEPGVLHLVEIMAKACGKEGARAHLKVRTAARKLIGKVRIKNVRYSESFRNASSQEYRDFLELFFRMVRGSLPATMCQHMDAGGVRMEVVSVTNGSIVVEFHLLIIADVDVQEVSAAFLTAFQTVPLLEVIRGDTFIQDYDECERKEDDCVPGTSCRNTLGSFTCSCEGGAPDFPVEYSERPCEGDSPGNETWATSPERPLTTAGTKAAFVQGTSPTPQGLPQRLNLTGAVRVLCEIEKVVVAIQKRFLQQESIPESSLYLSHPSCNVSHSNGTHVLLEAGWSECGTLMQSNMTNTVVRTTLRNDLSQEGIIHHLKILSPIYCAFQNDLLTSSGFTLEWGVYTIIEDLHGAGNFVTEMQLFIGDSPIPQNYSVSASDDVRIEVGLYRQKSNLKVVLTECWATPSSNARDPITFSFINNSCPVPNTYTNVIENGNSNKAQFKLRIFSFINDSIVYLHCKLRVCMESPGATCKINCNNFRLLQNSETSATHQMSWGPLIRSEGEPPHAEAGLGAGY

SEQ ID NO: 3116 - protein, 306 aa, synthetic construct
  REGION 1..306: note = UNC5A (Q6ZN44) SP+PP+ECD
MAVRPGLWPALLGIVLAAWLRGSGAQQSATVANPVPGANPDLLPHFLVEPEDVYIVKNKPVLLVCKAVPATQIFFKCNGEWVRQVDHVIERSTDGSSGLPTMEVRINVSRQQVEKVFGLEEYWCQCVAWSSSGTTKSQKAYIRIAYLRKNFEQEPLAKEVSLEQGIVLPCRPPEGIPPAEVEWLRNEDLVDPSLDPNVYITREHSLVVRQARLADTANYTCVAKNIVARRRSASAAVIVYVDGSWSPWSKWSACGLDCTHWRSRECSDPAPRNGGEECQGTDLDTRNCTSDLCVHTASGPEDVALY

SEQ ID NO: 3117 - protein, 377 aa, synthetic construct
  REGION 1..377: note = UNC5B (Q8IZJ1) SP+PP+ECD
MGARSGARGALLLALLLCWDPRLSQAGTDSGSEVLPDSFPSAPAEPLPYFLQEPQDAYIVKNKPVELRCRAFPATQIYFKCNGEWVSQNDHVTQEGLDEATGLRVREVQIEVSRQQVEELFGLEDYWCQCVAWSSAGTTKSRRAYVRIAYLRKNFDQEPLGKEVPLDHEVLLQCRPPEGVPVAEVEWLKNEDVIDPTQDTNFLLTIDHNLIIRQARLSDTANYTCVAKNIVAKRRSTTATVIVYVNGGWSSWAEWSPCSNRCGRGWQKRTRTCTNPAPLNGGAFCEGQAFQKTACTTICPVDGAWTEWSKWSACSTECAHWRSRECMAPPPQNGGRDCSGTLLDSKNCTDGLCMQNKKTLSDPNSHLLEASGDAALY

SEQ ID NO: 3118 - protein, 380 aa, synthetic construct
  REGION 1..380: note = UNC5C (O95185) SP+PP+ECD
MRKGLRATAARCGLGLGYLLQMLVLPALALLSASGTGSAAQDDDFFHELPETFPSDPPEPLPHFLIEPEEAYIVKNKPVNLYCKASPATQIYFKCNSEWVHQKDHIVDERVDETSGLIVREVSIEISRQQVEELFGPEDYWCQCVAWSSAGTTKSRKAYVRIAYLRKTFEQEPLGKEVSLEQEVLLQCRPPEGIPVAEVEWLKNEDIIDPVEDRNFYITIDHNLIIKQARLSDTANYTCVAKNIVAKRKSTTATVIVYVNGGWSTWTEWSVCNSRCGRGYQKRTRTCTNPAPLNGGAFCEGQSVQKIACTTLCPVDGRWTPWSKWSTCGTECTHWRRRECTAPAPKNGGKDCDGLVLQSKNCTDGLCMQTAPDSDDVALY

SEQ ID NO: 3119 - protein, 379 aa, synthetic construct
  REGION 1..379: note = UNC5D (Q6UXZ4) SP+PP+ECD
MGRAAATAGGGGGARRWLPWLGLCFWAAGTAAARGTDNGEALPESIPSAPGTLPHFIEEPDDAYIIKSNPIALRCKARPAMQIFFKCNGEWVHQNEHVSEETLDESSGLKVREVFINVTRQQVEDFHGPEDYWCQCVAWSHLGTSKSRKASVRIAYLRKNFEQDPQGREVPIEGMIVLHCRPPEGVPAAEVEWLKNEEPIDSEQDENIDTRADHNLIIRQARLSDSGNYTCMAANIVAKRRSLSATVVVYVNGGWSSWTEWSACNVRCGRGWQKRSRTCTNPAPLNGGAFCEGMSVQKITCTSLCPVDGSWEVWSEWSVCSPECEHLRIRECTAPPPRNGGKFCEGLSQESENCTDGLCILDKKPLHEIKPQSIENASD

SEQ ID NO: 3120 - protein, 155 aa, synthetic construct
  REGION 1..155: note = UPK2 (O00526) SP+PP+ECD
MAPLLPIRTLPLILILLALLSPGAADFNISSLSGLLSPALTESLLVALPPCHLTGGNATLMVRRANDSKVVTSSFVVPPCRGRRELVSVVDSGAGFTVTRLSAYQVTNLVPGTKFYISYLVKKGTATESSREIPMSTLPRRNMESIGLGMARTGG

SEQ ID NO: 3121 - protein, 207 aa, synthetic construct
  REGION 1..207: note = UPK3A (O75631) SP+PP+ECD
MPPLWALLALGCLRFGSAVNLQPQLASVTFATNNPTLTTVALEKPLCMFDSKEALTGTHEVYLYVLVDSAISRNASVQDSTNTPLGSTFLQTEGGRTGPYKAVAFDLIPCSDLPSLDAIGDVSKASQILNAYLVRVGANGTCLWDPNFQGLCNAPLSAATEYRFKYVLVNMSTGLVEDQTLWSDPIRTNQLTPYSTIDTWPGRRSGG

SEQ ID NO: 3122 - protein, 240 aa, synthetic construct
  REGION 1..240: note = UPK3B (Q9BT76) SP+PP+ECD
MGLPWGQPHLGLQMLLLALNCLRPSLSLGEWGSWMDASSQTQGAGGPAGVIGPWAPAPLRLGEAAPGTPTPVSVAHLLSPVATELVPYTPQITAWDLEGKVTATTFSLEQPRCVFDGLASASDTVWLVVAFSNASRGFQNPETLADIPASPQLLTDGHYMTLPLSPDQLPCGDPMAGSGGAPVLRVGHDHGCHQQPFCNAPLPGPGPYREDPRIHRHLARAAKWQHDRHYLHPLFSGRPP

SEQ ID NO: 3123 - protein, 204 aa, synthetic construct
  REGION 1..204: note = UPK3BL (B0FP48) SP+PP+ECD
MDNSWRLGPAIGLSAGQSQLLVSLLLLLTRVQPGTDVAAPEHISYVPQLSNDTLAGRLTLSTFTLEQPLGQFSSHNISDLDTIWLVVALSNATQSFTAPRTNQDIPAPANFSQRGYYLTLRANRVLYQTRGQLHVLRVGNDTHCQPTKIGCNHPLPGPGPYRVKFLVMNDEGPVAETKWSSDTRLQQAQALRAVPGPQSPGTVV

SEQ ID NO: 3124 - protein, 5042 aa, synthetic construct
  REGION 1..5042: note = USH2A (O75445) SP+PP+ECD
MNCPVLSLGSGFLFQVIEMLIFAYFASISLTESRGLFPRLENVGAFKKVSIVPTQAVCGLPDRSTFCHSSAAAESIQFCTQRFCIQDCPYRSSHPTYTALFSAGLSSCITPDKNDLHPNAHSNSASFIFGNHKSCFSSPPSPKLMASFTLAVWLKPEQQGVMCVIEKTVDGQIVFKLTISEKETMFYYRTVNGLQPPIKVMTLGRILVKKWIHLSVQVHQTKISFFINGVEKDHTPFNARTLSGSITDFASGTVQIGQSLNGLEQFVGRMQDFRLYQVALTNREILEVFSGDLLRLHAQSHCRCPGSHPRVHPLAQRYCIPNDAGDTADNRVSRLNPEAHPLSFVNDNDVGTSWVSNVFTNITQLNQGVTISVDLENGQYQVFYIIIQFFSPQPTEIRIQRKKENSLDWEDWQYFARNCGAFGMKNNGDLEKPDSVNCLQLSNFTPYSRGNVTFSILTPGPNYRPGYNNFYNTPSLQEFVKATQIRFHFHGQYYTTETAVNLRHRYYAVDEITISGRCQCHGHADNCDTTSQPYRCLCSQESFTEGLHCDRCLPLYNDKPFRQGDQVYAFNCKPCQCNSHSKSCHYNISVDPFPFEHFRGGGGVCDDCEHNTTGRNCELCKDYFFRQVGADPSAIDVCKPCDCDTVGTRNGSILCDQIGGQCNCKRHVSGRQCNQCQNGFYNLQELDPDGCSPCNCNTSGTVDGDITCHQNSGQCKCKANVIGLRCDHCNFGFKFLRSFNDVGCEPCQCNLHGSVNKFCNPHSGQCECKKEAKGLQCDTCRENFYGLDVTNCKACDCDTAGSLPGTVCNAKTGQCICKPNVEGRQCNKCLEGNFYLRQNNSFLCLPCNCDKTGTINGSLLCNKSTGQCPCKLGVTGLRCNQCEPHRYNLTIDNFQHCQMCECDSLGTLPGTICDPISGQCLCVPNRQGRRCNQCQPGFYISPGNATGCLPCSCHTTGAVNHICNSLTGQCVCQDASIAGQRCDQCKDHYFGFDPQTGRCQPCNCHLSGALNETCHLVTGQCFCKQFVTGSKCDACVPSASHLDVNNLLGCSKTPFQQPPPRGQVQSSSAINLSWSPPDSPNAHWLTYSLLRDGFEIYTTEDQYPYSIQYFLDTDLLPYTKYSYYIETTNVHGSTRSVAVTYKTKPGVPEGNLTLSYIIPIGSDSVTLTWTTLSNQSGPIEKYILSCAPLAGGQPCVSYEGHETSATIWNLVPFAKYDFSVQACTSGGCLHSLPITVTTAQAPPQRLSPPKMQKISSTELHVEWSPPAELNGIIIRYELYMRRLRSTKETTSEESRVFQSSGWLSPHSFVESANENALKPPQTMTTITGLEPYTKYEFRVLAVNMAGSVSSAWVSERTGESAPVFMIPPSVFPLSSYSLNISWEKPADNVTRGKVVGYDINMLSEQSPQQSIPMAFSQLLHTAKSQELSYTVEGLKPYRIYEFTITLCNSVGCVTSASGAGQTLAAAPAQLRPPLVKGINSTTIHLRWFPPEELNGPSPIYQLERRESSLPALMTTMMKGIRFIGNGYCKFPSSTHPVNTDFTGIKASFRTKVPEGLIVFAASPGNQEEYFALQLKKGRLYFLFDPQGSPVEVTTTNDHGKQYSDGKWHEIIAIRHQAFGQITLDGIYTGSSAILNGSTVIGDNTGVFLGGLPRSYTILRKDPEIIQKGFVGCLKDVHFMKNYNPSAIWEPLDWQSSEEQINVYNSWEGCPASLNEGAQFLGAGFLELHPYMFHGGMNFEISFKFRTDQLNGLLLFVYNKDGPDFLAMELKSGILTFRLNTSLAFTQVDLLLGLSYCNGKWNKVIIKKEGSFISASVNGLMKHASESGDQPLVVNSPVYVGGIPQELLNSYQHLCLEQGFGGCMKDVKFTRGAVVNLASVSSGAVRVNLDGCLSTDSAVNCRGNDSILVYQGKEQSVYEGGLQPFTEYLYRVIASHEGGSVYSDWSRGRTTGAAPQSVPTPSRVRSLNGYSIEVTWDEPVVRGVIEKYILKAYSEDSTRPPRMPSASAEFVNTSNLTGILTGLLPFKNYAVTLTACTLAGCTESSHALNISTPQEAPQEVQPPVAKSLPSSLLLSWNPPKKANGIITQYCLYMDGRLIYSGSEENYIVTDLAVFTPHQFLLSACTHVGCTNSSWVLLYTAQLPPEHVDSPVLTVLDSRTIHIQWKQPRKISGILERYVLYMSNHTHDFTIWSVIYNSTELFQDHMLQYVLPGNKYLIKLGACTGGGCTVSEASEALTDEDIPEGVPAPKAHSYSPDSFNVSWTEPEYPNGVITSYGLYLDGILIHNSSELSYRAYGFAPWSLHSFRVQACTAKGCALGPLVENRTLEAPPEGTVNVFVKTQGSRKAHVRWEAPFRPNGLLTHSVLFTGIFYVDPVGNNYTLLNVTKVMYSGEETNLWVLIDGLVPFTNYTVQVNISNSQGSLITDPITIAMPPGAPDGVLPPRLSSATPTSLQVVWSTPARNNAPGSPRYQLQMRSGDSTHGFLELFSNPSASLSYEVSDLQPYTEYMFRLVASNGFGSAHSSWIPFMTAEDKPGPVVPPILLDVKSRMMLVTWQHPRKSNGVITHYNIYLHGRLYLRTPGNVTNCTVMHLHPYTAYKFQVEACTSKGCSLSPESQTVWTLPGAPEGIPSPELFSDTPTSVIISWQPPTHPNGLVENFTIERRVKGKEEVTTLVTLPRSHSMRFIDKTSALSPWTKYEYRVLMSTLHGGTNSSAWVEVTTRPSRPAGVQPPVVTVLEPDAVQVTWKPPLIQNGDILSYEIHMPDPHITLTNVTSAVLSQKVTHLIPFTNYSVTIVACSGGNGYLGGCTESLPTYVTTHPTVPQNVGPLSVIPLSESYVVISWQPPSKPNGPNLRYELLRRKIQQPLASNPPEDLNRWHNIYSGTQWLYEDKGLSRFTTYEYMLFVHNSVGFTPSREVTVTTLAGLPERGANLTASVLNHTAIDVRWAKPTVQDLQGEVEYYTLFWSSATSNDSLKILPDVNSHVIGHLKPNTEYWIFISVFNGVHSINSAGLHATTCDGEPQGMLPPEVVIINSTAVRVIWTSPSNPNGVVTEYSIYVNNKLYKTGMNVPGSFILRDLSPFTIYDIQVEVCTIYACVKSNGTQITTVEDTPSDIPTPTIRGITSRSLQIDWVSPRKPNGIILGYDLLWKTWYPCAKTQKLVQDQSDELCKAVRCQKPESICGHICYSSEAKVCCNGVLYNPKPGHRCCEEKYIPFVLNSTGVCCGGRIQEAQPNHQCCSGYYARILPGEVCCPDEQHNRVSVGIGDSCCGRMPYSTSGNQICCAGRLHDGHGQKCCGRQIVSNDLECCGGEEGVVYNRLPGMFCCGQDYVNMSDTICCSASSGESKAHIKKNDPVPVKCCETELIPKSQKCCNGVGYNPLKYVCSDKISTGMMMKETKECRILCPASMEATEHCGRCDFNFTSHICTVIRGSHNSTGKASIEEMCSSAEETIHTGSVNTYSYTDVNLKPYMTYEYRISAWNSYGRGLSKAVRARTKEDVPQGVSPPTWTKIDNLEDTIVLNWRKPIQSNGPIIYYILLRNGIERFRGTSLSFSDKEGIQPFQEYSYQLKACTVAGCATSSKVVAATTQGVPESILPPSITALSAVALHLSWSVPEKSNGVIKEYQIRQVGKGLIHTDTTDRRQHTVTGLQPYTNYSFTLTACTSAGCTSSEPFLGQTLQAAPEGVWVTPRHIIINSTTVELYWSLPEKPNGLVSQYQLSRNGNLLFLGGSEEQNFTDKNLEPNSRYTYKLEVKTGGGSSASDDYIVQTPMSTPEEIYPPYNITVIGPYSIFVAWIPPGILIPEIPVEYNVLLNDGSVTPLAFSVGHHQSTLLENLTPFTQYEIRIQACQNGSCGVSSRMFVKTPEAAPMDLNSPVLKALGSACIEIKWMPPEKPNGIIINYFIYRRPAGIEEESVLFVWSEGALEFMDEGDTLRPFTLYEYRVRACNSKGSVESLWSLTQTLEAPPQDFPAPWAQATSAHSVLLNWTKPESPNGIISHYRVVYQERPDDPTFNSPTVHAFTVKGTSHQAHLYGLEPFTTYRIGVVAANHAGEILSPWTLIQTLESSPSGLRNFIVEQKENGRALLLQWSEPMRTNGVIKTYNIFSDGFLEYSGLNRQFLFRRLDPFTLYTLTLEACTRAGCAHSAPQPLWTDEAPPDSQLAPTVHSVKSTSVELSWSEPVNPNGKIIRYEVIRRCFEGKAWGNQTIQADEKIVFTEYNTERNTFMYNDTGLQPWTQCEYKIYTWNSAGHTCSSWNVVRTLQAPPEGLSPPVISYVSMNPQKLLISWIPPEQSNGIIQSYRLQRNEMLYPFSFDPVTFNYTDEELLPFSTYSYALQACTSGGCSTSKPTSITTLEAAPSEVSPPDLWAVSATQMNVCWSPPTVQNGKITKYLVRYDNKESLAGQGLCLLVSHLQPYSQYNFSLVACTNGGCTASVSKSAWTMEALPENMDSPTLQVTGSESIEITWKPPRNPNGQIRSYELRRDGTIVYTGLETRYRDFTLTPGVEYSYTVTASNSQGGILSPLVKDRTSPSAPSGMEPPKLQARGPQEILVNWDPPVRTNGDIINYTLFIRELFERETKIIHINTTHNSFGMQSYIVNQLKPFHRYEIRIQACTTLGCASSDWTFIQTPEIAPLMQPPPHLEVQMAPGGFQPTVSLLWTGPLQPNGKVLYYELYRRQIATQPRKSNPVLIYNGSSTSFIDSELLPFTEYEYQVWAVNSAGKAPSSWTWCRTGPAPPEGLRAPTFHVISSTQAVVNISAPGKPNGIVSLYRLFSSSAHGAETVLSEGMATQQTLHGLQAFTNYSIGVEACTCFNCCSKGPTAELRTHPAPPSGLSSPQIGTLASRTASFRWSPPMFPNGVIHSYELQFHVACPPDSALPCTPSQIETKYTGLGQKASLGGLQPYTTYKLRVVAHNEVGSTASEWISFTTQKELPQYRAPFSVDSNLSVVCVNWSDTFLLNGQLKEYVLTDGGRRVYSGLDTTLYIPRTADKTFFFQVICTTDEGSVKTPLIQYDTSTGLGLVLTTPGKKKGSRSKSTEFYSELW

SEQ ID NO: 3125 - protein, 575 aa, synthetic construct
  REGION 1..575: note = VASN (Q6EMK4) SP+PP+ECD
MCSRVPLLLPLLLLLALGPGVQGCPSGCQCSQPQTVFCTARQGTTVPRDVPPDTVGLYVFENGITMLDAGSFAGLPGLQLLDLSQNQIASLPSGVFQPLANLSNLDLTANRLHEITNETFRGLRRLERLYLGKNRIRHIQPGAFDTLDRLLELKLQDNELRALPPLRLPRLLLLDLSHNSLLALEPGILDTANVEALRLAGLGLQQLDEGLFSRLRNLHDLDVSDNQLERVPPVIRGLRGLTRLRLAGNTRIAQLRPEDLAGLAALQELDVSNLSLQALPGDLSGLFPRLRLLAAARNPFNCVCPLSWFGPWVRESHVTLASPEETRCHFPPKNAGRLLLELDYADFGCPATTTTATVPTTRPVVREPTALSSSLAPTWLSPTEPATEAPSPPSTAPPTVGPVPQPQDCPPSTCLNGGTCHLGTRHHLACLCPEGFTGLYCESQMGQGTRPSPTPVTPRPPRSLTLGIEPVSPTSLRVGLQRYLQGSSVQLRSLRLTYRNLSGPDKRLVTLRLPASLAEYTVTQLRPNATYSVCVMPLGPGRVPEGEEACGEAHTPPAVHSNHAPVTQAREGNLP

SEQ ID NO: 3126 - protein, 698 aa, synthetic construct
  REGION 1..698: note = VCAM1 (P19320) SP+PP+ECD
MPGKMVVILGASNILWIMFAASQAFKIETTPESRYLAQIGDSVSLTCSTTGCESPFFSWRTQIDSPLNGKVTNEGTTSTLTMNPVSFGNEHSYLCTATCESRKLEKGIQVEIYSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQEKPFTVEISPGPRIAAQIGDSVMLTCSVMGCESPSFSWRTQIDSPLSGKVRSEGTNSTLTLSPVSFENEHSYLCTVTCGHKKLEKGIQVELYSFPRDPEIEMSGGLVNGSSVTVSCKVPSVYPLDRLEIELLKGETILENIEFLEDTDMKSLENKSLEMTFIPTIEDTGKALVCQAKLHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPE

SEQ ID NO: 3127 - protein, 797 aa, synthetic construct
  REGION 1..797: note = VLDLR (P98155) SP+PP+ECD
MGTSALWALWLLLALCWAPRESGATGTGRKAKCEPSQFQCTNGRCITLLWKCDGDEDCVDGSDEKNCVKKTCAESDFVCNNGQCVPSRWKCDGDPDCEDGSDESPEQCHMRTCRIHEISCGAHSTQCIPVSWRCDGENDCDSGEDEENCGNITCSPDEFTCSSGRCISRNFVCNGQDDCSDGSDELDCAPPTCGAHEFQCSTSSCIPISWVCDDDADCSDQSDESLEQCGRQPVIHTKCPASEIQCGSGECIHKKWRCDGDPDCKDGSDEVNCPSRTCRPDQFECEDGSCIHGSRQCNGIRDCVDGSDEVNCKNVNQCLGPGKFKCRSGECIDISKVCNQEQDCRDWSDEPLKECHINECLVNNGGCSHICKDLVIGYECDCAAGFELIDRKTCGDIDECQNPGICSQICINLKGGYKCECSRGYQMDLATGVCKAVGKEPSLIFTNRRDIRKIGLERKEYIQLVEQLRNTVALDADIAAQKLFWADLSQKAIFSASIDDKVGRHVKMIDNVYNPAAIAVDWVYKTIYWTDAASKTISVATLDGTKRKFLFNSDLREPASIAVDPLSGFVYWSDWGEPAKIEKAGMNGFDRRPLVTADIQWPNGITLDLIKSRLYWLDSKLHMLSSVDLNGQDRRIVLKSLEFLAHPLALTIFEDRVYWIDGENEAVYGANKFTGSELATLVNNLNDAQDIIVYHELVQPSGKNWCEEDMENGGCEYLCLPAPQINDHSPKYTCSCPSGYNVEENGRDCQSTATTVTYSETKDTNTTEISATSGLVPGGINVTTAVSEVSVPPKGTS

SEQ ID NO: 3128 - protein, 232 aa, synthetic construct
  REGION 1..232: note = VSIG1 (Q86XK7) SP+PP+ECD
MVFAFWKVFLILSCLAGQVSVVQVTIPDGFVNVTVGSNVTLICIYTTTVASREQLSIQWSFFHKKEMEPISIYFSQGGQAVAIGQFKDRITGSNDPGNASITISHMQPADSGIYICDVNNPPDFLGQNQGILNVSVLVKPSKPLCSVQGRPETGHTISLSCLSALGTPSPVYYWHKLEGRDIVPVKENFNPTTGILVIGNLTNFEQGYYQCTAINRLGNSSCEIDLTSSHPE

SEQ ID NO: 3129 - protein, 413 aa, synthetic construct
  REGION 1..413: note = VSIG10 (Q8N0Z9) SP+PP+ECD
MAAGGSAPEPRVLVCLGALLAGWVAVGLEAVVIGEVHENVTLHCGNISGLRGQVTWYRNNSEPVFLLSSNSSLRPAEPRFSLVDATSLHIESLSLGDEGIYTCQEILNVTQWFQVWLQVASGPYQIEVHIVATGTLPNGTLYAARGSQVDFSCNSSSRPPPVVEWWFQALNSSSESFGHNLTVNFFSLLLISPNLQGNYTCLALNQLSKRHRKVTTELLVYYPPPSAPQCWAQMASGSFMLQLTCRWDGGYPDPDFLWIEEPGGVIVGKSKLGVEMLSESQLSDGKKFKCVTSHIVGPESGASCMVQIRGPSLLSEPMKTCFTGGNVTLTCQVSGAYPPAKILWLRNLTQPEVIIQPSSRHLITQDGQNSTLTIHNCSQDLDEGYYICRADSPVGVREMEIWLSVKEPLNIGG

SEQ ID NO: 3130 - protein, 776 aa, synthetic construct
  REGION 1..776: note = VSIG10L (Q86VR7) SP+PP+ECD
MDNPQALPLFLLLASLVGILTLRASSGLQQTNFSSAFSSDSKSSSQGLGVEVPSIKPPSWKVPDQFLDSKASAGISDSSWFPEALSSNMSGSFWSNVSAEGQDLSPVSPFSETPGSEVFPDISDPQVPAKDPKPSFTVKTPASNISTQVSHTKLSVEAPDSKFSPDDMDLKLSAQSPESKFSAETHSAASFPQQVGGPLAVLVGTTIRLPLVPIPNPGPPTSLVVWRRGSKVLAAGGLGPGAPLISLDPAHRDHLRFDQARGVLELASAQLDDAGVYTAEVIRAGVSQQTHEFTVGVYEPLPQLSVQPKAPETEEGAAELRLRCLGWGPGRGELSWSRDGRALEAAESEGAETPRMRSEGDQLLIVRPVRSDHARYTCRVRSPFGHREAAADVSVFYGPDPPTITVSSDRDAAPARFVTAGSNVTLRCAAASRPPADITWSLADPAEAAVPAGSRLLLPAVGPGHAGTYACLAANPRTGRRRRSLLNLTVADLPPGAPQCSVEGGPGDRSLRFRCSWPGGAPAASLQFQGLPEGIRAGPVSSVLLAAVPAHPRLSGVPITCLARHLVATRTCTVTPEAPREVLLHPLVAETRLGEAEVALEASGCPPPSRASWAREGRPLAPGGGSRLRLSQDGRKLHIGNFSLDWDLGNYSVLCSGALGAGGDQITLIGPSISSWRLQRARDAAVLTWDVERGALISSFEIQAWPDGPALGRTSTYRDWVSLLILGPQERSAVVPLPPRNPGTWTFRILPILGGQPGTPSQSRVYRAGPTLSHGA

SEQ ID NO: 3131 - protein, 243 aa, synthetic construct
  REGION 1..243: note = VSIG2 (Q96IQ7) SP+PP+ECD
MAELPGPFLCGALLGFLCLSGLAVEVKVPTEPLSTPLGKTAELTCTYSTSVGDSFALEWSFVQPGKPISESHPILYFTNGHLYPTGSKSKRVSLLQNPPTVGVATLKLTDVHPSDTGTYLCQVNNPPDFYTNGLGLINLTVLVPPSNPLCSQSGQTSVGGSTALRCSSSEGAPKPVYNWVRLGTFPTPSPGSMVQDEVSGQLILTNLSLTSSGTYRCVATNQMGSASCELTLSVTEPSQGRVA

SEQ ID NO: 3132 - protein, 135 aa, synthetic construct
  REGION 1..135: note = VSTM1 (Q6UX27) SP+PP+ECD
MTAEFLSLLCLGLCLGYEDEKKNEKPPKPSLHAWPSSVVEAESNVTLKCQAHSQNVTFVLRKVNDSGYKQEQSSAENEAEFPFTDLKPKDAGRYFCAYKTTASHEWSESSEHLQLVVTDKHDELEAPSMKTDTRT

SEQ ID NO: 3133 - protein, 180 aa, synthetic construct
  REGION 1..180: note = VSTM4 (Q8IW00) SP+PP+ECD
MRLLALAAAALLARAPAPEVCAALNVTVSPGPVVDYLEGENATLLCHVSQKRRKDSLLAVRWFFAHSFDSQEALMVKMTKLRVVQYYGNFSRSAKRRRLRLLEEQRGALYRLSVLTLQPSDQGHYVCRVQEISRHRNKWTAWSNGSSATEMRVISLKASEESSFEKTKETWAFFEDLYVY

SEQ ID NO: 3134 - protein, 147 aa, synthetic construct
  REGION 1..147: note = VSTM5 (A8MXK1) SP+PP+ECD
MRPLPSGRRKTRGISLGLFALCLAAARCLQSQGVSLYIPQATINATVKEDILLSVEYSCHGVPTIEWTYSSNWGTQKIVEWKPGTQANISQSHKDRVCTFDNGSIQLFSVGVRDSGYYVITVTERLGSSQFGTIVLHVSEILYEDLH

SEQ ID NO: 3135 - protein, 259 aa, synthetic construct
  REGION 1..259: note = VTCN1 (Q7Z7D3) SP+PP+ECD
MASLGQILFWSIISIIIILAGAIALIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKAS

SEQ ID NO: 3136 - protein, 2757 aa, synthetic construct
  REGION 1..2757: note = ZAN (Q9Y493) SP+PP+ECD
MVPPVWTLLLLVGAALFRKEKPPDQKLVVRSSRDNYVLTQCDFEDDAKPLCDWSQVSADDEDWVRASGPSPTGSTGAPGGYPNGEGSYLHMESNSFHRGGVARLLSPDLWEQGPLCVHFAHHMFGLSWGAQLRLLLLSGEEGRRPDVLWKHWNTQRPSWMLTTVTVPAGFTLPTRLMFEGTRGSTAYLDIALDALSIRRGSCNRVCMMQTCSFDIPNDLCDWTWIPTASGAKWTQKKGSSGKPGVGPDGDFSSPGSGCYMLLDPKNARPGQKAVLLSPVSLSSGCLSFSFHYILRGQSPGAALHIYASVLGSIRKHTLFSGQPGPNWQAVSVNYTAVGRIQFAVVGVFGKTPEPAVAVDATSIAPCGEGFPQCDFEDNAHPFCDWVQTSGDGGHWALGHKNGPVHGMGPAGGFPNAGGHYIYLEADEFSQAGQSVRLVSRPFCAPGDICVEFAYHMYGLGEGTMLELLLGSPAGSPPIPLWKRVGSQRPYWQNTSVTVPSGHQQPMQLIFKGIQGSNTASVVAMGFILINPGTCPVKVLPELPPVSPVSSTGPSETTGLTENPTISTKKPTVSIEKPSVTTEKPTVPKEKPTIPTEKPTISTEKPTIPSEKPNMPSEKPTIPSEKPTILTEKPTIPSEKPTIPSEKPTISTEKPTVPTEEPTTPTEETTTSMEEPVIPTEKPSIPTEKPSIPTEKPTISMEETIISTEKPTISPEKPTIPTEKPTIPTEKSTISPEKPTTPTEKPTIPTEKPTISPEKPTTPTEKPTISPEKLTIPTEKPTIPTEKPTIPTEKPTISTEEPTTPTEETTISTEKPSIPMEKPTLPTEETTTSVEETTISTEKLTIPMEKPTISTEKPTIPTEKPTISPEKLTIPTEKLTIPTEKPTIPIEETTISTEKLTIPTEKPTISPEKPTISTEKPTIPTEKPTIPTEETTISTEKLTIPTEKPTISPEKLTIPTEKPTISTEKPTIPTEKLTIPTEKPTIPTEKPTIPTEKLTALRPPHPSPTATGLAALVMSPHAPSTPMTSVILGTTTTSRSSTERCPPNARYESCACPASCKSPRPSCGPLCREGCVCNPGFLFSDNHCIQASSCNCFYNNDYYEPGAEWFSPNCTEHCRCWPGSRVECQISQCGTHTVCQLKNGQYGCHPYAGTATCLVYGDPHYVTFDGRHFGFMGKCTYILAQPCGNSTDPFFRVTAKNEEQGQEGVSCLSKVYVTLPESTVTLLKGRRTLVGGQQVTLPAIPSKGVFLGASGRFVELQTEFGLRVRWDGDQQLYVTVSSTYSGKLCGLCGNYDGNSDNDHLKLDGSPAGDKEELGNSWQTDQDEDQECQKYQVVNSPSCDSSLQSSMSGPGFCGRLVDTHGPFETCLLHVKAASFFDSCMLDMCGFQGLQHLLCTHMSTMTTTCQDAGHAVKPWREPHFCPMACPPNSKYSLCAKPCPDTCHSGFSGMFCSDRCVEACECNPGFVLSGLECIPRSQCGCLHPAGSYFKVGERWYKPGCKELCVCESNNRIRCQPWRCRAQEFCGQQDGIYGCHAQGAATCTASGDPHYLTFDGALHHFMGTCTYVLTRPCWSRSQDSYFVVSATNENRGGILEVSYIKAVHVTVFDLSISLLRGCKVMLNGHRVALPVWLAQGRVTIRLSSNLVLLYTNFGLQVRYDGSHLVEVTVPSSYGGQLCGLCGNYNNNSLDDNLRPDRKLAGDSMQLGAAWKLPESSEPGCFLVGGKPSSCQENSMADAWNKNCAILINPQGPFSQCHQVVPPQSSFASCVHGQCGTKGDTTALCRSLQAYASLCAQAGQAPAWRNRTFCPMRCPPGSSYSPCSSPCPDTCSSINNPRDCPKALPCAESCECQKGHILSGTSCVPLGQCGCTDPAGSYHPVGERWYTENTCTRLCTCSVHNNITCFQSTCKPNQICWALDGLLHCRASGVGVCQLPGESHYVSFDGSNHSIPDACTLVLVKVCHPAMALPFFKISAKHEKEEGGTEAFRLHEVYIDIYDAQVTLQKGHRVLINSKQVTLPAISQIPGVSVKSSSIYSIVNIKIGVQVKFDGNHLLEIEIPTTYYGKVCGMCGNFNDEEEDELMMPSDEVANSDSEFVNSWKDKDIDPSCQSLLVDEQQIPAEQQENPSGNCRAADLRRAREKCEAALRAPVWAQCASRIDLTPFLVDCANTLCEFGGLYQALCQALQAFGATCQSQGLKPPLWRNSSFCPLECPAYSSYTNCLPSCSPSCWDLDGRCEGAKVPSACAEGCICQPGYVLSEDKCVPRSQCGCKDAHGGSIPLGKSWVSSGCTEKCVCTGGAIQCGDFRCPSGSHCQLTSDNSNSNCVSDKSEQCSVYGDPRYLTFDGFSYRLQGRMTYVLIKTVDVLPEGVEPLLVEGRNKMDPPRSSIFLQEVITTVYGYKVQLQAGLELVVNNQKMAVPYRPNEHLRVTLWGQRLYLVTDFELVVSFGGRKNAVISLPSMYEGLVSGLCGNYDKNRKNDMMLPSGALTQNLNTFGNSWEVKTEDALLRFPRAIPAEEEGQGAELGLRTGLQVSECSPEQLASNSTQACRVLADPQGPFAACHQTVAPEPFQEHCVLDLCSAQDPREQEELRCQVLSGHGVSSRYHISELYDTLPSILCQPGRPRGLRGPLRGRLRQHPRLCLQWHPEPPLADCGCTSNGIYYQLGSSFLTEDCSQRCTCASSRILLCEPFSCRAGEVCTLGNHTQGCFPESPCLQNPCQNDGQCREQGATFTCECEVGYGGGLCMEPRDAPPPRKPAS

SEQ ID NO: 3137 - protein, 250 aa, synthetic construct
  REGION 1..250: note = ZNRF4 (Q8WWF5) SP+PP+ECD
MPLCRPEHLMPRASRVPVAASLPLSHAVIPTQLPSRPGHRPPGRPRRCPKASCLPPPVGPSSTQTAKRVTMGWPRPGRALVAVKALLVLSLLQVPAQAVVRAVLEDNSSSVDFADLPALFGVPLAPEGIRGYLMEVKPANACHPIEAPRLGNRSLGAIVLIRRYDCTFDLKVLNAQRAGFEAAIVHNVHSDDLVSMTHVYEDLRGQIAIPSVFVSEAASQDLRVILGCNKSAHALLLPDDPPCHDLGCHP

SEQ ID NO: 3138 - protein, 601 aa, synthetic construct
  REGION 1..601: note = ZP1 (P60852) SP+PP+ECD
MAGGSATTWGYPVALLLLVATLGLGRWLQPDPGLPGLRHSYDCGIKGMQLLVFPRPGQTLRFKVVDEFGNRFDVNNCSICYHWVTSRPQEPAVFSADYRGCHVLEKDGRFHLRVFMEAVLPNGRVDVAQDATLICPKPDPSRTLDSQLAPPAMFSVSTPQTLSFLPTSGHTSQGSGHAFPSPLDPGHSSVHPTPALPSPGPGPTLATLAQPHWGTLEHWDVNKRDYIGTHLSQEQCQVASGHLPCIVRRTSKEACQQAGCCYDNTREVPCYYGNTATVQCFRDGYFVLVVSQEMALTHRITLANIHLAYAPTSCSPTQHTEAFVVFYFPLTHCGTTMQVAGDQLIYENWLVSGIHIQKGPQGSITRDSTFQLHVRCVFNASDFLPIQASIFPPPSPAPMTQPGPLRLELRIAKDETFSSYYGEDDYPIVRLLREPVHVEVRLLQRTDPNLVLLLHQCWGAPSANPFQQPQWPILSDGCPFKGDSYRTQMVALDGATPFQSHYQRFTVATFALLDSGSQRALRGLVYLFCSTSACHTSGLETCSTACSTGTTRQRRSSGHRNDTARPQDIVSSPGPVGFEDSYGQEPTLGPTDSNGNSSLRP

SEQ ID NO: 3139 - protein, 716 aa, synthetic construct
  REGION 1..716: note = ZP2 (Q05996) SP+PP+ECD
MACRQRGGSWSPSGWFNAGWSTYRSISLFFALVTSGNSIDVSQLVNPAFPGTVTCDEREITVEFPSSPGTKKWHASVVDPLGLDMPNCTYILDPEKLTLRATYDNCTRRVHGGHQMTIRVMNNSAALRHGAVMYQFFCPAMQVEETQGLSASTICQKDFMSFSLPRVFSGLADDSKGTKVQMGWSIEVGDGARAKTLTLPEAMKEGFSLLIDNHRMTFHVPFNATGVTHYVQGNSHLYMVSLKLTFISPGQKVIFSSQAICAPDPVTCNATHMTLTIPEFPGKLKSVSFENQNIDVSQLHDNGIDLEATNGMKLHFSKTLLKTKLSEKCLLHQFYLASLKLTFLLRPETVSMVIYPECLCESPVSIVTGELCTQDGFMDVEVYSYQTQPALDLGTLRVGNSSCQPVFEAQSQGLVRFHIPLNGCGTRYKFEDDKVVYENEIHALWTDFPPSKISRDSEFRMTVKCSYSRNDMLLNINVESLTPPVASVKLGPFTLILQSYPDNSYQQPYGENEYPLVRFLRQPIYMEVRVLNRDDPNIKLVLDDCWATSTMDPDSFPQWNVVVDGCAYDLDNYQTTFHPVGSSVTHPDHYQRFDMKAFAFVSEAHVLSSLVYFHCSALICNRLSPDSPLCSVTCPVSSRHRRATGATEAEKMTVSLPGPILLLSDDSSFRGVGSSDLKASGSSGEKSRSETGEEVGSRGAMDTKGHKTAGDVGSKA

SEQ ID NO: 3140 - protein, 387 aa, synthetic construct
  REGION 1..387: note = ZP3 (P21754) SP+PP+ECD
MELSYRLFICLLLWGSTELCYPQPLWLLQGGASHPETSVQPVLVECQEATLMVMVSKDLFGTGKLIRAADLTLGPEACEPLVSMDTEDVVRFEVGLHECGNSMQVTDDALVYSTFLLHDPRPVGNLSIVRTNRAEIPIECRYPRQGNVSSQAILPTWLPFRTTVFSEEKLTFSLRLMEENWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSV

SEQ ID NO: 3141 - protein, 505 aa, synthetic construct
  REGION 1..505: note = ZP4 (Q12836) SP+PP+ECD
MWLLRCVLLCVSLSLAVSGQHKPEAPDYSSVLHCGPWSFQFAVNLNQEATSPPVLIAWDNQGLLHELQNDSDCGTWIRKGPGSSVVLEATYSSCYVTEWDSHYIMPVGVEGAGAAEHKVVTERKLLKCPMDLLARDAPDTDWCDSIPARDRLPCAPSPISRGDCEGLGCCYSSEEVNSCYYGNTVTLHCTREGHFSIAVSRNVTSPPLLLDSVRLALRNDSACNPVMATQAFVLFQFPFTSCGTTRQITGDRAVYENELVATRDVKNGSRGSVTRDSIFRLHVSCSYSVSSNSLPINVQVFTLPPPFPETQPGPLTLELQIAKDKNYGSYYGVGDYPVVKLLRDPIYVEVSILHRTDPYLGLLLQQCWATPSTDPLSQPQWPILVKGCPYIGDNYQTQLIPVQKALDLPFPSHHQRFSIFTFSFVNPTVEKQALRGPVHLHCSVSVCQPAETPSCVVTCPDLSRRRNFDNSSQNTTASVSSKGPMILLQATKDPPEKLRVPVDSK

SEQ ID NO: 3142 - protein, 372 aa, synthetic construct
  REGION 1..372: note = ZPLD1 (Q8TCW7) SP+PP+ECD
MEQIWLLLLLTIRVLPGSAQFNGYNCDANLHSRFPAERDISVYCGVQAITMKINFCTVLFSGYSETDLALNGRHGDSHCRGFINNNTFPAVVIFIINLSTLEGCGNNLVVSTIPGVSAYGNATSVQVGNISGYIDTPDPPTIISYLPGLLYKFSCSYPLEYLVNNTQLASSSAAISVRENNGTFVSTLNLLLYNDSTYNQQLIIPSIGLPLKTKVFAAVQATNLDGRWNVLMDYCYTTPSGNPNDDIRYDLFLSCDKDPQTTVIENGRSQRGRFSFEVFRFVKHKNQKMSTVFLHCVTKLCRADDCPFLMPICSHRERRDAGRRTTWSPQSSSGSAVLSAGPIITRSDETPTNNSQLGSPSMPPFQLNAITS

SEQ ID NO: 3143 - protein, 8 aa, synthetic construct
  REGION 1..8: note = Gly-Ser Linker
GGGSGGGS

SEQ ID NO: 3144 - protein, 9 aa, synthetic construct
  REGION 1..9: note = Gly-Ser Linker
GGGSGGGSG

SEQ ID NO: 3145 - protein, 10 aa, synthetic construct
  REGION 1..10: note = Gly-Ser Linker
GGGSGGGSGG

SEQ ID NO: 3146 - protein, 11 aa, synthetic construct
  REGION 1..11: note = Gly-Ser Linker
GGGSGGGSGGG

SEQ ID NO: 3147 - protein, 12 aa, synthetic construct
  REGION 1..12: note = Gly-Ser Linker
GGGSGGGSGGGS

SEQ ID NO: 3148 - protein, 13 aa, synthetic construct
  REGION 1..13: note = Gly-Ser Linker
GGGSGGGSGGGSG

SEQ ID NO: 3149 - protein, 14 aa, synthetic construct
  REGION 1..14: note = Gly-Ser Linker
GGGSGGGSGGGSGG

SEQ ID NO: 3150 - protein, 15 aa, synthetic construct
  REGION 1..15: note = Gly-Ser Linker
GGGSGGGSGGGSGGG

SEQ ID NO: 3151 - protein, 16 aa, synthetic construct
  REGION 1..16: note = Gly-Ser Linker
GGGSGGGSGGGSGGGS

SEQ ID NO: 3152 - protein, 17 aa, synthetic construct
  REGION 1..17: note = Gly-Ser Linker
GGGSGGGSGGGSGGGSG

SEQ ID NO: 3153 - protein, 18 aa, synthetic construct
  REGION 1..18: note = Gly-Ser Linker
GGGSGGGSGGGSGGGSGG

SEQ ID NO: 3154 - protein, 19 aa, synthetic construct
  REGION 1..19: note = Gly-Ser Linker
GGGSGGGSGGGSGGGSGGG

SEQ ID NO: 3155 - protein, 20 aa, synthetic construct
  REGION 1..20: note = Gly-Ser Linker
GGGSGGGSGGGSGGGSGGGS

SEQ ID NO: 3156 - protein, 21 aa, synthetic construct
  REGION 1..21: note = Gly-Ser Linker
GGGSGGGSGGGSGGGSGGGSG

SEQ ID NO: 3157 - protein, 22 aa, synthetic construct
  REGION 1..22: note = Gly-Ser Linker
GGGSGGGSGGGSGGGSGGGSGG

SEQ ID NO: 3158 - protein, 23 aa, synthetic construct
  REGION 1..23: note = Gly-Ser Linker
GGGSGGGSGGGSGGGSGGGSGGG

SEQ ID NO: 3159 - protein, 24 aa, synthetic construct
  REGION 1..24: note = Gly-Ser Linker
GGGSGGGSGGGSGGGSGGGSGGGS

SEQ ID NO: 3160 - protein, 25 aa, synthetic construct
  REGION 1..25: note = Gly-Ser Linker
GGGSGGGSGGGSGGGSGGGSGGGSG

SEQ ID NO: 3161 - protein, 26 aa, synthetic construct
  REGION 1..26: note = Gly-Ser Linker
GGGSGGGSGGGSGGGSGGGSGGGSGG

SEQ ID NO: 3162 - protein, 27 aa, synthetic construct
  REGION 1..27: note = Gly-Ser Linker
GGGSGGGSGGGSGGGSGGGSGGGSGGG

SEQ ID NO: 3163 - protein, 5 aa, synthetic construct
  REGION 1..5: note = Gly-Ser Linker
GGGGS

SEQ ID NO: 3164 - protein, 6 aa, synthetic construct
  REGION 1..6: note = Gly-Ser Linker
GGGGSG

SEQ ID NO: 3165 - protein, 7 aa, synthetic construct
  REGION 1..7: note = Gly-Ser Linker
GGGGSGG

SEQ ID NO: 3166 - protein, 8 aa, synthetic construct
  REGION 1..8: note = Gly-Ser Linker
GGGGSGGG

SEQ ID NO: 3167 - protein, 10 aa, synthetic construct
  REGION 1..10: note = Gly-Ser Linker
GGGGSGGGGS

SEQ ID NO: 3168 - protein, 11 aa, synthetic construct
  REGION 1..11: note = Gly-Ser Linker
GGGGSGGGGSG

SEQ ID NO: 3169 - protein, 12 aa, synthetic construct
  REGION 1..12: note = Gly-Ser Linker
GGGGSGGGGSGG

SEQ ID NO: 3170 - protein, 13 aa, synthetic construct
  REGION 1..13: note = Gly-Ser Linker
GGGGSGGGGSGGG

SEQ ID NO: 3171 - protein, 15 aa, synthetic construct
  REGION 1..15: note = Gly-Ser Linker
GGGGSGGGGSGGGGS

SEQ ID NO: 3172 - protein, 16 aa, synthetic construct
  REGION 1..16: note = Gly-Ser Linker
GGGGSGGGGSGGGGSG

SEQ ID NO: 3173 - protein, 17 aa, synthetic construct
  REGION 1..17: note = Gly-Ser Linker
GGGGSGGGGSGGGGSGG

SEQ ID NO: 3174 - protein, 18 aa, synthetic construct
  REGION 1..18: note = Gly-Ser Linker
GGGGSGGGGSGGGGSGGG

SEQ ID NO: 3175 - protein, 20 aa, synthetic construct
  REGION 1..20: note = Gly-Ser Linker
GGGGSGGGGSGGGGSGGGGS

SEQ ID NO: 3176 - protein, 21 aa, synthetic construct
  REGION 1..21: note = Gly-Ser Linker
GGGGSGGGGSGGGGSGGGGSG

SEQ ID NO: 3177 - protein, 22 aa, synthetic construct
  REGION 1..22: note = Gly-Ser Linker
GGGGSGGGGSGGGGSGGGGSGG

SEQ ID NO: 3178 - protein, 23 aa, synthetic construct
  REGION 1..23: note = Gly-Ser Linker
GGGGSGGGGSGGGGSGGGGSGGG

SEQ ID NO: 3179 - protein, 25 aa, synthetic construct
  REGION 1..25: note = Gly-Ser Linker
GGGGSGGGGSGGGGSGGGGSGGGGS

SEQ ID NO: 3180 - protein, 26 aa, synthetic construct
  REGION 1..26: note = Gly-Ser Linker
GGGGSGGGGSGGGGSGGGGSGGGGSG

SEQ ID NO: 3181 - protein, 27 aa, synthetic construct
  REGION 1..27: note = Gly-Ser Linker
GGGGSGGGGSGGGGSGGGGSGGGGSGG

SEQ ID NO: 3182 - protein, 28 aa, synthetic construct
  REGION 1..28: note = Gly-Ser Linker
GGGGSGGGGSGGGGSGGGGSGGGGSGGG

SEQ ID NO: 3183 - protein, 4 aa, synthetic construct
  REGION 1..4: note = Gly-Ala Linker
GGGA

SEQ ID NO: 3184 - protein, 5 aa, synthetic construct
  REGION 1..5: note = Gly-Ala Linker
GGGAG

SEQ ID NO: 3185 - protein, 6 aa, synthetic construct
  REGION 1..6: note = Gly-Ala Linker
GGGAGG

SEQ ID NO: 3186 - protein, 7 aa, synthetic construct
  REGION 1..7: note = Gly-Ala Linker
GGGAGGG

SEQ ID NO: 3187 - protein, 8 aa, synthetic construct
  REGION 1..8: note = Gly-Ala Linker
GGGAGGGA

SEQ ID NO: 3188 - protein, 9 aa, synthetic construct
  REGION 1..9: note = Gly-Ala Linker
GGGAGGGAG

SEQ ID NO: 3189 - protein, 10 aa, synthetic construct
  REGION 1..10: note = Gly-Ala Linker
GGGAGGGAGG

SEQ ID NO: 3190 - protein, 11 aa, synthetic construct
  REGION 1..11: note = Gly-Ala Linker
GGGAGGGAGGG

SEQ ID NO: 3191 - protein, 12 aa, synthetic construct
  REGION 1..12: note = Gly-Ala Linker
GGGAGGGAGGGA

SEQ ID NO: 3192 - protein, 13 aa, synthetic construct
  REGION 1..13: note = Gly-Ala Linker
GGGAGGGAGGGAG

SEQ ID NO: 3193 - protein, 14 aa, synthetic construct
  REGION 1..14: note = Gly-Ala Linker
GGGAGGGAGGGAGG

SEQ ID NO: 3194 - protein, 15 aa, synthetic construct
  REGION 1..15: note = Gly-Ala Linker
GGGAGGGAGGGAGGG

SEQ ID NO: 3195 - protein, 16 aa, synthetic construct
  REGION 1..16: note = Gly-Ala Linker
GGGAGGGAGGGAGGGA

SEQ ID NO: 3196 - protein, 17 aa, synthetic construct
  REGION 1..17: note = Gly-Ala Linker
GGGAGGGAGGGAGGGAG

SEQ ID NO: 3197 - protein, 18 aa, synthetic construct
  REGION 1..18: note = Gly-Ala Linker
GGGAGGGAGGGAGGGAGG

SEQ ID NO: 3198 - protein, 19 aa, synthetic construct
  REGION 1..19: note = Gly-Ala Linker
GGGAGGGAGGGAGGGAGGG

SEQ ID NO: 3199 - protein, 20 aa, synthetic construct
  REGION 1..20: note = Gly-Ala Linker
GGGAGGGAGGGAGGGAGGGA

SEQ ID NO: 3200 - protein, 21 aa, synthetic construct
  REGION 1..21: note = Gly-Ala Linker
GGGAGGGAGGGAGGGAGGGAG

SEQ ID NO: 3201 - protein, 22 aa, synthetic construct
  REGION 1..22: note = Gly-Ala Linker
GGGAGGGAGGGAGGGAGGGAGG

SEQ ID NO: 3202 - protein, 23 aa, synthetic construct
  REGION 1..23: note = Gly-Ala Linker
GGGAGGGAGGGAGGGAGGGAGGG

SEQ ID NO: 3203 - protein, 24 aa, synthetic construct
  REGION 1..24: note = Gly-Ala Linker
GGGAGGGAGGGAGGGAGGGAGGGA

SEQ ID NO: 3204 - protein, 25 aa, synthetic construct
  REGION 1..25: note = Gly-Ala Linker
GGGAGGGAGGGAGGGAGGGAGGGAG

SEQ ID NO: 3205 - protein, 26 aa, synthetic construct
  REGION 1..26: note = Gly-Ala Linker
GGGAGGGAGGGAGGGAGGGAGGGAGG

SEQ ID NO: 3206 - protein, 27 aa, synthetic construct
  REGION 1..27: note = Gly-Ala Linker
GGGAGGGAGGGAGGGAGGGAGGGAGGG

SEQ ID NO: 3207 - protein, 5 aa, synthetic construct
  REGION 1..5: note = Gly-Ala Linker
GGGGA

SEQ ID NO: 3208 - protein, 6 aa, synthetic construct
  REGION 1..6: note = Gly-Ala Linker
GGGGAG

SEQ ID NO: 3209 - protein, 7 aa, synthetic construct
  REGION 1..7: note = Gly-Ala Linker
GGGGAGG

SEQ ID NO: 3210 - protein, 8 aa, synthetic construct
  REGION 1..8: note = Gly-Ala Linker
GGGGAGGG

SEQ ID NO: 3211 - protein, 10 aa, synthetic construct
  REGION 1..10: note = Gly-Ala Linker
GGGGAGGGGA

SEQ ID NO: 3212 - protein, 11 aa, synthetic construct
  REGION 1..11: note = Gly-Ala Linker
GGGGAGGGGAG

SEQ ID NO: 3213 - protein, 12 aa, synthetic construct
  REGION 1..12: note = Gly-Ala Linker
GGGGAGGGGAGG

SEQ ID NO: 3214 - protein, 13 aa, synthetic construct
  REGION 1..13: note = Gly-Ala Linker
GGGGAGGGGAGGG

SEQ ID NO: 3215 - protein, 15 aa, synthetic construct
  REGION 1..15: note = Gly-Ala Linker
GGGGAGGGGAGGGGA

SEQ ID NO: 3216 - protein, 16 aa, synthetic construct
  REGION 1..16: note = Gly-Ala Linker
GGGGAGGGGAGGGGAG

SEQ ID NO: 3217 - protein, 17 aa, synthetic construct
  REGION 1..17: note = Gly-Ala Linker
GGGGAGGGGAGGGGAGG

SEQ ID NO: 3218 - protein, 18 aa, synthetic construct
  REGION 1..18: note = Gly-Ala Linker
GGGGAGGGGAGGGGAGGG

SEQ ID NO: 3219 - protein, 20 aa, synthetic construct
  REGION 1..20: note = Gly-Ala Linker
GGGGAGGGGAGGGGAGGGGA

SEQ ID NO: 3220 - protein, 21 aa, synthetic construct
  REGION 1..21: note = Gly-Ala Linker
GGGGAGGGGAGGGGAGGGGAG

SEQ ID NO: 3221 - protein, 22 aa, synthetic construct
  REGION 1..22: note = Gly-Ala Linker
GGGGAGGGGAGGGGAGGGGAGG

SEQ ID NO: 3222 - protein, 23 aa, synthetic construct
  REGION 1..23: note = Gly-Ala Linker
GGGGAGGGGAGGGGAGGGGAGGG

SEQ ID NO: 3223 - protein, 25 aa, synthetic construct
  REGION 1..25: note = Gly-Ala Linker
GGGGAGGGGAGGGGAGGGGAGGGGA

SEQ ID NO: 3224 - protein, 26 aa, synthetic construct
  REGION 1..26: note = Gly-Ala Linker
GGGGAGGGGAGGGGAGGGGAGGGGAG

SEQ ID NO: 3225 - protein, 27 aa, synthetic construct
  REGION 1..27: note = Gly-Ala Linker
GGGGAGGGGAGGGGAGGGGAGGGGAGG

SEQ ID NO: 3226 - protein, 28 aa, synthetic construct
  REGION 1..28: note = Gly-Ala Linker
GGGGAGGGGAGGGGAGGGGAGGGGAGGG

SEQ ID NO: 3227 - protein, 57 aa, synthetic construct
  REGION 1..57: note = TNR1B Linker (1-57)
TSTSPTRSMAPGAVHLPQPVSTRSQHTQPTPEPSTAPSTSFLLPMGPSPPAEGSTGD

SEQ ID NO: 3228 - protein, 56 aa, synthetic construct
  REGION 1..56: note = TNR1B Linker (2-57)
STSPTRSMAPGAVHLPQPVSTRSQHTQPTPEPSTAPSTSFLLPMGPSPPAEGSTGD

SEQ ID NO: 3229 - protein, 55 aa, synthetic construct
  REGION 1..55: note = TNR1B Linker (3-57)
TSPTRSMAPGAVHLPQPVSTRSQHTQPTPEPSTAPSTSFLLPMGPSPPAEGSTGD

SEQ ID NO: 3230 - protein, 54 aa, synthetic construct
  REGION 1..54: note = TNR1B Linker (4-57)
SPTRSMAPGAVHLPQPVSTRSQHTQPTPEPSTAPSTSFLLPMGPSPPAEGSTGD

SEQ ID NO: 3231 - protein, 53 aa, synthetic construct
  REGION 1..53: note = TNR1B Linker (5-57)
PTRSMAPGAVHLPQPVSTRSQHTQPTPEPSTAPSTSFLLPMGPSPPAEGSTGD

SEQ ID NO: 3232 - protein, 52 aa, synthetic construct
  REGION 1..52: note = TNR1B Linker (6-57)
TRSMAPGAVHLPQPVSTRSQHTQPTPEPSTAPSTSFLLPMGPSPPAEGSTGD

SEQ ID NO: 3233 - protein, 51 aa, synthetic construct
  REGION 1..51: note = TNR1B Linker (7-57)
RSMAPGAVHLPQPVSTRSQHTQPTPEPSTAPSTSFLLPMGPSPPAEGSTGD

SEQ ID NO: 3234 - protein, 50 aa, synthetic construct
  REGION 1..50: note = TNR1B Linker (8-57)
SMAPGAVHLPQPVSTRSQHTQPTPEPSTAPSTSFLLPMGPSPPAEGSTGD

SEQ ID NO: 3235 - protein, 49 aa, synthetic construct
  REGION 1..49: note = TNR1B Linker (9-57)
MAPGAVHLPQPVSTRSQHTQPTPEPSTAPSTSFLLPMGPSPPAEGSTGD

SEQ ID NO: 3236 - protein, 48 aa, synthetic construct
  REGION 1..48: note = TNR1B Linker (10-57)
APGAVHLPQPVSTRSQHTQPTPEPSTAPSTSFLLPMGPSPPAEGSTGD

SEQ ID NO: 3237 - protein, 47 aa, synthetic construct
  REGION 1..47: note = TNR1B Linker (11-57)
PGAVHLPQPVSTRSQHTQPTPEPSTAPSTSFLLPMGPSPPAEGSTGD

SEQ ID NO: 3238 - protein, 46 aa, synthetic construct
  REGION 1..46: note = TNR1B Linker (12-57)
GAVHLPQPVSTRSQHTQPTPEPSTAPSTSFLLPMGPSPPAEGSTGD

SEQ ID NO: 3239 - protein, 45 aa, synthetic construct
  REGION 1..45: note = TNR1B Linker (13-57)
AVHLPQPVSTRSQHTQPTPEPSTAPSTSFLLPMGPSPPAEGSTGD

SEQ ID NO: 3240 - protein, 44 aa, synthetic construct
  REGION 1..44: note = TNR1B Linker (14-57)
VHLPQPVSTRSQHTQPTPEPSTAPSTSFLLPMGPSPPAEGSTGD

SEQ ID NO: 3241 - protein, 43 aa, synthetic construct
  REGION 1..43: note = TNR1B Linker (15-57)
HLPQPVSTRSQHTQPTPEPSTAPSTSFLLPMGPSPPAEGSTGD

SEQ ID NO: 3242 - protein, 42 aa, synthetic construct
  REGION 1..42: note = TNR1B Linker (16-57)
LPQPVSTRSQHTQPTPEPSTAPSTSFLLPMGPSPPAEGSTGD

SEQ ID NO: 3243 - protein, 41 aa, synthetic construct
  REGION 1..41: note = TNR1B Linker (17-57)
PQPVSTRSQHTQPTPEPSTAPSTSFLLPMGPSPPAEGSTGD

SEQ ID NO: 3244 - protein, 40 aa, synthetic construct
  REGION 1..40: note = TNR1B Linker (18-57)
QPVSTRSQHTQPTPEPSTAPSTSFLLPMGPSPPAEGSTGD

SEQ ID NO: 3245 - protein, 39 aa, synthetic construct
  REGION 1..39: note = TNR1B Linker (19-57)
PVSTRSQHTQPTPEPSTAPSTSFLLPMGPSPPAEGSTGD

SEQ ID NO: 3246 - protein, 38 aa, synthetic construct
  REGION 1..38: note = TNR1B Linker (20-57)
VSTRSQHTQPTPEPSTAPSTSFLLPMGPSPPAEGSTGD

SEQ ID NO: 3247 - protein, 37 aa, synthetic construct
  REGION 1..37: note = TNR1B Linker (21-57)
STRSQHTQPTPEPSTAPSTSFLLPMGPSPPAEGSTGD

SEQ ID NO: 3248 - protein, 36 aa, synthetic construct
  REGION 1..36: note = TNR1B Linker (22-57)
TRSQHTQPTPEPSTAPSTSFLLPMGPSPPAEGSTGD

SEQ ID NO: 3249 - protein, 35 aa, synthetic construct
  REGION 1..35: note = TNR1B Linker (23-57)
RSQHTQPTPEPSTAPSTSFLLPMGPSPPAEGSTGD

SEQ ID NO: 3250 - protein, 34 aa, synthetic construct
  REGION 1..34: note = TNR1B Linker (24-57)
SQHTQPTPEPSTAPSTSFLLPMGPSPPAEGSTGD

SEQ ID NO: 3251 - protein, 33 aa, synthetic construct
  REGION 1..33: note = TNR1B Linker (25-57)
QHTQPTPEPSTAPSTSFLLPMGPSPPAEGSTGD

SEQ ID NO: 3252 - protein, 32 aa, synthetic construct
  REGION 1..32: note = TNR1B Linker (26-57)
HTQPTPEPSTAPSTSFLLPMGPSPPAEGSTGD

SEQ ID NO: 3253 - protein, 31 aa, synthetic construct
  REGION 1..31: note = TNR1B Linker (27-57)
TQPTPEPSTAPSTSFLLPMGPSPPAEGSTGD

SEQ ID NO: 3254 - protein, 30 aa, synthetic construct
  REGION 1..30: note = TNR1B Linker (28-57)
QPTPEPSTAPSTSFLLPMGPSPPAEGSTGD

SEQ ID NO: 3255 - protein, 29 aa, synthetic construct
  REGION 1..29: note = TNR1B Linker (29-57)
PTPEPSTAPSTSFLLPMGPSPPAEGSTGD

SEQ ID NO: 3256 - protein, 28 aa, synthetic construct
  REGION 1..28: note = TNR1B Linker (30-57)
TPEPSTAPSTSFLLPMGPSPPAEGSTGD

SEQ ID NO: 3257 - protein, 27 aa, synthetic construct
  REGION 1..27: note = TNR1B Linker (31-57)
PEPSTAPSTSFLLPMGPSPPAEGSTGD

SEQ ID NO: 3258 - protein, 26 aa, synthetic construct
  REGION 1..26: note = TNR1B Linker (32-57)
EPSTAPSTSFLLPMGPSPPAEGSTGD

SEQ ID NO: 3259 - protein, 25 aa, synthetic construct
  REGION 1..25: note = TNR1B Linker (33-57)
PSTAPSTSFLLPMGPSPPAEGSTGD

SEQ ID NO: 3260 - protein, 24 aa, synthetic construct
  REGION 1..24: note = TNR1B Linker (34-57)
STAPSTSFLLPMGPSPPAEGSTGD

SEQ ID NO: 3261 - protein, 23 aa, synthetic construct
  REGION 1..23: note = TNR1B Linker (35-57)
TAPSTSFLLPMGPSPPAEGSTGD

SEQ ID NO: 3262 - protein, 22 aa, synthetic construct
  REGION 1..22: note = TNR1B Linker (36-57)
APSTSFLLPMGPSPPAEGSTGD

SEQ ID NO: 3263 - protein, 21 aa, synthetic construct
  REGION 1..21: note = TNR1B Linker (37-57)
PSTSFLLPMGPSPPAEGSTGD

SEQ ID NO: 3264 - protein, 20 aa, synthetic construct
  REGION 1..20: note = TNR1B Linker (38-57)
STSFLLPMGPSPPAEGSTGD

SEQ ID NO: 3265 - protein, 19 aa, synthetic construct
  REGION 1..19: note = TNR1B Linker (39-57)
TSFLLPMGPSPPAEGSTGD

SEQ ID NO: 3266 - protein, 18 aa, synthetic construct
  REGION 1..18: note = TNR1B Linker (40-57)
SFLLPMGPSPPAEGSTGD

SEQ ID NO: 3267 - protein, 17 aa, synthetic construct
  REGION 1..17: note = TNR1B Linker (41-57)
FLLPMGPSPPAEGSTGD

SEQ ID NO: 3268 - protein, 16 aa, synthetic construct
  REGION 1..16: note = TNR1B Linker (42-57)
LLPMGPSPPAEGSTGD

SEQ ID NO: 3269 - protein, 15 aa, synthetic construct
  REGION 1..15: note = TNR1B Linker (43-57)
LPMGPSPPAEGSTGD

SEQ ID NO: 3270 - protein, 14 aa, synthetic construct
  REGION 1..14: note = TNR1B Linker (44-57)
PMGPSPPAEGSTGD

SEQ ID NO: 3271 - protein, 13 aa, synthetic construct
  REGION 1..13: note = TNR1B Linker (45-57)
MGPSPPAEGSTGD

SEQ ID NO: 3272 - protein, 12 aa, synthetic construct
  REGION 1..12: note = TNR1B Linker (46-57)
GPSPPAEGSTGD

SEQ ID NO: 3273 - protein, 11 aa, synthetic construct
  REGION 1..11: note = TNR1B Linker (47-57)
PSPPAEGSTGD

SEQ ID NO: 3274 - protein, 10 aa, synthetic construct
  REGION 1..10: note = TNR1B Linker (48-57)
SPPAEGSTGD

SEQ ID NO: 3275 - protein, 9 aa, synthetic construct
  REGION 1..9: note = TNR1B Linker (49-57)
PPAEGSTGD

SEQ ID NO: 3276 - protein, 8 aa, synthetic construct
  REGION 1..8: note = TNR1B Linker (50-57)
PAEGSTGD

SEQ ID NO: 3277 - protein, 7 aa, synthetic construct
  REGION 1..7: note = TNR1B Linker (51-57)
AEGSTGD

SEQ ID NO: 3278 - protein, 6 aa, synthetic construct
  REGION 1..6: note = TNR1B Linker (52-57)
EGSTGD

SEQ ID NO: 3279 - protein, 5 aa, synthetic construct
  REGION 1..5: note = TNR1B Linker (53-57)
GSTGD

SEQ ID NO: 3280 - protein, 56 aa, synthetic construct
  REGION 1..56: note = TNR1B Linker (1-56)
TSTSPTRSMAPGAVHLPQPVSTRSQHTQPTPEPSTAPSTSFLLPMGPSPPAEGSTG

SEQ ID NO: 3281 - protein, 55 aa, synthetic construct
  REGION 1..55: note = TNR1B Linker (2-56)
STSPTRSMAPGAVHLPQPVSTRSQHTQPTPEPSTAPSTSFLLPMGPSPPAEGSTG

SEQ ID NO: 3282 - protein, 54 aa, synthetic construct
  REGION 1..54: note = TNR1B Linker (3-56)
TSPTRSMAPGAVHLPQPVSTRSQHTQPTPEPSTAPSTSFLLPMGPSPPAEGSTG

SEQ ID NO: 3283 - protein, 53 aa, synthetic construct
  REGION 1..53: note = TNR1B Linker (4-56)
SPTRSMAPGAVHLPQPVSTRSQHTQPTPEPSTAPSTSFLLPMGPSPPAEGSTG

SEQ ID NO: 3284 - protein, 52 aa, synthetic construct
  REGION 1..52: note = TNR1B Linker (5-56)
PTRSMAPGAVHLPQPVSTRSQHTQPTPEPSTAPSTSFLLPMGPSPPAEGSTG

SEQ ID NO: 3285 - protein, 51 aa, synthetic construct
  REGION 1..51: note = TNR1B Linker (6-56)
TRSMAPGAVHLPQPVSTRSQHTQPTPEPSTAPSTSFLLPMGPSPPAEGSTG

SEQ ID NO: 3286 - protein, 50 aa, synthetic construct
  REGION 1..50: note = TNR1B Linker (7-56)
RSMAPGAVHLPQPVSTRSQHTQPTPEPSTAPSTSFLLPMGPSPPAEGSTG

SEQ ID NO: 3287 - protein, 49 aa, synthetic construct
  REGION 1..49: note = TNR1B Linker (8-56)
SMAPGAVHLPQPVSTRSQHTQPTPEPSTAPSTSFLLPMGPSPPAEGSTG

SEQ ID NO: 3288 - protein, 48 aa, synthetic construct
  REGION 1..48: note = TNR1B Linker (9-56)
MAPGAVHLPQPVSTRSQHTQPTPEPSTAPSTSFLLPMGPSPPAEGSTG

SEQ ID NO: 3289 - protein, 47 aa, synthetic construct
  REGION 1..47: note = TNR1B Linker (10-56)
APGAVHLPQPVSTRSQHTQPTPEPSTAPSTSFLLPMGPSPPAEGSTG

SEQ ID NO: 3290 - protein, 46 aa, synthetic construct
  REGION 1..46: note = TNR1B Linker (11-56)
PGAVHLPQPVSTRSQHTQPTPEPSTAPSTSFLLPMGPSPPAEGSTG

SEQ ID NO: 3291 - protein, 45 aa, synthetic construct
  REGION 1..45: note = TNR1B Linker (12-56)
GAVHLPQPVSTRSQHTQPTPEPSTAPSTSFLLPMGPSPPAEGSTG

SEQ ID NO: 3292 - protein, 44 aa, synthetic construct
  REGION 1..44: note = TNR1B Linker (13-56)
AVHLPQPVSTRSQHTQPTPEPSTAPSTSFLLPMGPSPPAEGSTG

SEQ ID NO: 3293 - protein, 43 aa, synthetic construct
  REGION 1..43: note = TNR1B Linker (14-56)
VHLPQPVSTRSQHTQPTPEPSTAPSTSFLLPMGPSPPAEGSTG

SEQ ID NO: 3294 - protein, 42 aa, synthetic construct
  REGION 1..42: note = TNR1B Linker (15-56)
HLPQPVSTRSQHTQPTPEPSTAPSTSFLLPMGPSPPAEGSTG

SEQ ID NO: 3295 - protein, 41 aa, synthetic construct
  REGION 1..41: note = TNR1B Linker (16-56)
LPQPVSTRSQHTQPTPEPSTAPSTSFLLPMGPSPPAEGSTG

SEQ ID NO: 3296 - protein, 40 aa, synthetic construct
  REGION 1..40: note = TNR1B Linker (17-56)
PQPVSTRSQHTQPTPEPSTAPSTSFLLPMGPSPPAEGSTG

SEQ ID NO: 3297 - protein, 39 aa, synthetic construct
  REGION 1..39: note = TNR1B Linker (18-56)
QPVSTRSQHTQPTPEPSTAPSTSFLLPMGPSPPAEGSTG

SEQ ID NO: 3298 - protein, 38 aa, synthetic construct
  REGION 1..38: note = TNR1B Linker (19-56)
PVSTRSQHTQPTPEPSTAPSTSFLLPMGPSPPAEGSTG

SEQ ID NO: 3299 - protein, 37 aa, synthetic construct
  REGION 1..37: note = TNR1B Linker (20-56)
VSTRSQHTQPTPEPSTAPSTSFLLPMGPSPPAEGSTG

SEQ ID NO: 3300 - protein, 36 aa, synthetic construct
  REGION 1..36: note = TNR1B Linker (21-56)
STRSQHTQPTPEPSTAPSTSFLLPMGPSPPAEGSTG

SEQ ID NO: 3301 - protein, 35 aa, synthetic construct
  REGION 1..35: note = TNR1B Linker (22-56)
TRSQHTQPTPEPSTAPSTSFLLPMGPSPPAEGSTG

SEQ ID NO: 3302 - protein, 34 aa, synthetic construct
  REGION 1..34: note = TNR1B Linker (23-56)
RSQHTQPTPEPSTAPSTSFLLPMGPSPPAEGSTG

SEQ ID NO: 3303 - protein, 33 aa, synthetic construct
  REGION 1..33: note = TNR1B Linker (24-56)
SQHTQPTPEPSTAPSTSFLLPMGPSPPAEGSTG

SEQ ID NO: 3304 - protein, 32 aa, synthetic construct
  REGION 1..32: note = TNR1B Linker (25-56)
QHTQPTPEPSTAPSTSFLLPMGPSPPAEGSTG

SEQ ID NO: 3305 - protein, 31 aa, synthetic construct
  REGION 1..31: note = TNR1B Linker (26-56)
HTQPTPEPSTAPSTSFLLPMGPSPPAEGSTG

SEQ ID NO: 3306 - protein, 30 aa, synthetic construct
  REGION 1..30: note = TNR1B Linker (27-56)
TQPTPEPSTAPSTSFLLPMGPSPPAEGSTG

SEQ ID NO: 3307 - protein, 29 aa, synthetic construct
  REGION 1..29: note = TNR1B Linker (28-56)
QPTPEPSTAPSTSFLLPMGPSPPAEGSTG

SEQ ID NO: 3308 - protein, 28 aa, synthetic construct
  REGION 1..28: note = TNR1B Linker (29-56)
PTPEPSTAPSTSFLLPMGPSPPAEGSTG

SEQ ID NO: 3309 - protein, 27 aa, synthetic construct
  REGION 1..27: note = TNR1B Linker (30-56)
TPEPSTAPSTSFLLPMGPSPPAEGSTG

SEQ ID NO: 3310 - protein, 26 aa, synthetic construct
  REGION 1..26: note = TNR1B Linker (31-56)
PEPSTAPSTSFLLPMGPSPPAEGSTG

SEQ ID NO: 3311 - protein, 25 aa, synthetic construct
  REGION 1..25: note = TNR1B Linker (32-56)
EPSTAPSTSFLLPMGPSPPAEGSTG

SEQ ID NO: 3312 - protein, 24 aa, synthetic construct
  REGION 1..24: note = TNR1B Linker (33-56)
PSTAPSTSFLLPMGPSPPAEGSTG

SEQ ID NO: 3313 - protein, 23 aa, synthetic construct
  REGION 1..23: note = TNR1B Linker (34-56)
STAPSTSFLLPMGPSPPAEGSTG

SEQ ID NO: 3314 - protein, 22 aa, synthetic construct
  REGION 1..22: note = TNR1B Linker (35-56)
TAPSTSFLLPMGPSPPAEGSTG

SEQ ID NO: 3315 - protein, 21 aa, synthetic construct
  REGION 1..21: note = TNR1B Linker (36-56)
APSTSFLLPMGPSPPAEGSTG

SEQ ID NO: 3316 - protein, 20 aa, synthetic construct
  REGION 1..20: note = TNR1B Linker (37-56)
PSTSFLLPMGPSPPAEGSTG

SEQ ID NO: 3317 - protein, 19 aa, synthetic construct
  REGION 1..19: note = TNR1B Linker (38-56)
STSFLLPMGPSPPAEGSTG

SEQ ID NO: 3318 - protein, 18 aa, synthetic construct
  REGION 1..18: note = TNR1B Linker (39-56)
TSFLLPMGPSPPAEGSTG

SEQ ID NO: 3319 - protein, 17 aa, synthetic construct
  REGION 1..17: note = TNR1B Linker (40-56)
SFLLPMGPSPPAEGSTG

SEQ ID NO: 3320 - protein, 16 aa, synthetic construct
  REGION 1..16: note = TNR1B Linker (41-56)
FLLPMGPSPPAEGSTG

SEQ ID NO: 3321 - protein, 15 aa, synthetic construct
  REGION 1..15: note = TNR1B Linker (42-56)
LLPMGPSPPAEGSTG

SEQ ID NO: 3322 - protein, 14 aa, synthetic construct
  REGION 1..14: note = TNR1B Linker (43-56)
LPMGPSPPAEGSTG

SEQ ID NO: 3323 - protein, 13 aa, synthetic construct
  REGION 1..13: note = TNR1B Linker (44-56)
PMGPSPPAEGSTG

SEQ ID NO: 3324 - protein, 12 aa, synthetic construct
  REGION 1..12: note = TNR1B Linker (45-56)
MGPSPPAEGSTG

SEQ ID NO: 3325 - protein, 11 aa, synthetic construct
  REGION 1..11: note = TNR1B Linker (46-56)
GPSPPAEGSTG

SEQ ID NO: 3326 - protein, 10 aa, synthetic construct
  REGION 1..10: note = TNR1B Linker (47-56)
PSPPAEGSTG

SEQ ID NO: 3327 - protein, 9 aa, synthetic construct
  REGION 1..9: note = TNR1B Linker (48-56)
SPPAEGSTG

SEQ ID NO: 3328 - protein, 8 aa, synthetic construct
  REGION 1..8: note = TNR1B Linker (49-56)
PPAEGSTG

SEQ ID NO: 3329 - protein, 7 aa, synthetic construct
  REGION 1..7: note = TNR1B Linker (50-56)
PAEGSTG

SEQ ID NO: 3330 - protein, 6 aa, synthetic construct
  REGION 1..6: note = TNR1B Linker (51-56)
AEGSTG

SEQ ID NO: 3331 - protein, 5 aa, synthetic construct
  REGION 1..5: note = TNR1B Linker (52-56)
EGSTG

SEQ ID NO: 3332 - protein, 55 aa, synthetic construct
  REGION 1..55: note = TNR1B Linker (1-55)
TSTSPTRSMAPGAVHLPQPVSTRSQHTQPTPEPSTAPSTSFLLPMGPSPPAEGST

SEQ ID NO: 3333 - protein, 54 aa, synthetic construct
  REGION 1..54: note = TNR1B Linker (2-55)
STSPTRSMAPGAVHLPQPVSTRSQHTQPTPEPSTAPSTSFLLPMGPSPPAEGST

SEQ ID NO: 3334 - protein, 53 aa, synthetic construct
  REGION 1..53: note = TNR1B Linker (3-55)
TSPTRSMAPGAVHLPQPVSTRSQHTQPTPEPSTAPSTSFLLPMGPSPPAEGST

SEQ ID NO: 3335 - protein, 52 aa, synthetic construct
  REGION 1..52: note = TNR1B Linker (4-55)
SPTRSMAPGAVHLPQPVSTRSQHTQPTPEPSTAPSTSFLLPMGPSPPAEGST

SEQ ID NO: 3336 - protein, 51 aa, synthetic construct
  REGION 1..51: note = TNR1B Linker (5-55)
PTRSMAPGAVHLPQPVSTRSQHTQPTPEPSTAPSTSFLLPMGPSPPAEGST

SEQ ID NO: 3337 - protein, 50 aa, synthetic construct
  REGION 1..50: note = TNR1B Linker (6-55)
TRSMAPGAVHLPQPVSTRSQHTQPTPEPSTAPSTSFLLPMGPSPPAEGST

SEQ ID NO: 3338 - protein, 49 aa, synthetic construct
  REGION 1..49: note = TNR1B Linker (7-55)
RSMAPGAVHLPQPVSTRSQHTQPTPEPSTAPSTSFLLPMGPSPPAEGST

SEQ ID NO: 3339 - protein, 48 aa, synthetic construct
  REGION 1..48: note = TNR1B Linker (8-55)
SMAPGAVHLPQPVSTRSQHTQPTPEPSTAPSTSFLLPMGPSPPAEGST

SEQ ID NO: 3340 - protein, 47 aa, synthetic construct
  REGION 1..47: note = TNR1B Linker (9-55)
MAPGAVHLPQPVSTRSQHTQPTPEPSTAPSTSFLLPMGPSPPAEGST

SEQ ID NO: 3341 - protein, 46 aa, synthetic construct
  REGION 1..46: note = TNR1B Linker (10-55)
APGAVHLPQPVSTRSQHTQPTPEPSTAPSTSFLLPMGPSPPAEGST

SEQ ID NO: 3342 - protein, 45 aa, synthetic construct
  REGION 1..45: note = TNR1B Linker (11-55)
PGAVHLPQPVSTRSQHTQPTPEPSTAPSTSFLLPMGPSPPAEGST

SEQ ID NO: 3343 - protein, 44 aa, synthetic construct
  REGION 1..44: note = TNR1B Linker (12-55)
GAVHLPQPVSTRSQHTQPTPEPSTAPSTSFLLPMGPSPPAEGST

SEQ ID NO: 3344 - protein, 43 aa, synthetic construct
  REGION 1..43: note = TNR1B Linker (13-55)
AVHLPQPVSTRSQHTQPTPEPSTAPSTSFLLPMGPSPPAEGST

SEQ ID NO: 3345 - protein, 42 aa, synthetic construct
  REGION 1..42: note = TNR1B Linker (14-55)
VHLPQPVSTRSQHTQPTPEPSTAPSTSFLLPMGPSPPAEGST

SEQ ID NO: 3346 - protein, 41 aa, synthetic construct
  REGION 1..41: note = TNR1B Linker (15-55)
HLPQPVSTRSQHTQPTPEPSTAPSTSFLLPMGPSPPAEGST

SEQ ID NO: 3347 - protein, 40 aa, synthetic construct
  REGION 1..40: note = TNR1B Linker (16-55)
LPQPVSTRSQHTQPTPEPSTAPSTSFLLPMGPSPPAEGST

SEQ ID NO: 3348 - protein, 39 aa, synthetic construct
  REGION 1..39: note = TNR1B Linker (17-55)
PQPVSTRSQHTQPTPEPSTAPSTSFLLPMGPSPPAEGST

SEQ ID NO: 3349 - protein, 38 aa, synthetic construct
  REGION 1..38: note = TNR1B Linker (18-55)
QPVSTRSQHTQPTPEPSTAPSTSFLLPMGPSPPAEGST

SEQ ID NO: 3350 - protein, 37 aa, synthetic construct
  REGION 1..37: note = TNR1B Linker (19-55)
PVSTRSQHTQPTPEPSTAPSTSFLLPMGPSPPAEGST

SEQ ID NO: 3351 - protein, 36 aa, synthetic construct
  REGION 1..36: note = TNR1B Linker (20-55)
VSTRSQHTQPTPEPSTAPSTSFLLPMGPSPPAEGST

SEQ ID NO: 3352 - protein, 35 aa, synthetic construct
  REGION 1..35: note = TNR1B Linker (21-55)
STRSQHTQPTPEPSTAPSTSFLLPMGPSPPAEGST

SEQ ID NO: 3353 - protein, 34 aa, synthetic construct
  REGION 1..34: note = TNR1B Linker (22-55)
TRSQHTQPTPEPSTAPSTSFLLPMGPSPPAEGST

SEQ ID NO: 3354 - protein, 33 aa, synthetic construct
  REGION 1..33: note = TNR1B Linker (23-55)
RSQHTQPTPEPSTAPSTSFLLPMGPSPPAEGST

SEQ ID NO: 3355 - protein, 32 aa, synthetic construct
  REGION 1..32: note = TNR1B Linker (24-55)
SQHTQPTPEPSTAPSTSFLLPMGPSPPAEGST

SEQ ID NO: 3356 - protein, 31 aa, synthetic construct
  REGION 1..31: note = TNR1B Linker (25-55)
QHTQPTPEPSTAPSTSFLLPMGPSPPAEGST

SEQ ID NO: 3357 - protein, 30 aa, synthetic construct
  REGION 1..30: note = TNR1B Linker (26-55)
HTQPTPEPSTAPSTSFLLPMGPSPPAEGST

SEQ ID NO: 3358 - protein, 29 aa, synthetic construct
  REGION 1..29: note = TNR1B Linker (27-55)
TQPTPEPSTAPSTSFLLPMGPSPPAEGST

SEQ ID NO: 3359 - protein, 28 aa, synthetic construct
  REGION 1..28: note = TNR1B Linker (28-55)
QPTPEPSTAPSTSFLLPMGPSPPAEGST

SEQ ID NO: 3360 - protein, 27 aa, synthetic construct
  REGION 1..27: note = TNR1B Linker (29-55)
PTPEPSTAPSTSFLLPMGPSPPAEGST

SEQ ID NO: 3361 - protein, 26 aa, synthetic construct
  REGION 1..26: note = TNR1B Linker (30-55)
TPEPSTAPSTSFLLPMGPSPPAEGST

SEQ ID NO: 3362 - protein, 25 aa, synthetic construct
  REGION 1..25: note = TNR1B Linker (31-55)
PEPSTAPSTSFLLPMGPSPPAEGST

SEQ ID NO: 3363 - protein, 24 aa, synthetic construct
  REGION 1..24: note = TNR1B Linker (32-55)
EPSTAPSTSFLLPMGPSPPAEGST

SEQ ID NO: 3364 - protein, 23 aa, synthetic construct
  REGION 1..23: note = TNR1B Linker (33-55)
PSTAPSTSFLLPMGPSPPAEGST

SEQ ID NO: 3365 - protein, 22 aa, synthetic construct
  REGION 1..22: note = TNR1B Linker (34-55)
STAPSTSFLLPMGPSPPAEGST

SEQ ID NO: 3366 - protein, 21 aa, synthetic construct
  REGION 1..21: note = TNR1B Linker (35-55)
TAPSTSFLLPMGPSPPAEGST

SEQ ID NO: 3367 - protein, 20 aa, synthetic construct
  REGION 1..20: note = TNR1B Linker (36-55)
APSTSFLLPMGPSPPAEGST

SEQ ID NO: 3368 - protein, 19 aa, synthetic construct
  REGION 1..19: note = TNR1B Linker (37-55)
PSTSFLLPMGPSPPAEGST

SEQ ID NO: 3369 - protein, 18 aa, synthetic construct
  REGION 1..18: note = TNR1B Linker (38-55)
STSFLLPMGPSPPAEGST

SEQ ID NO: 3370 - protein, 17 aa, synthetic construct
  REGION 1..17: note = TNR1B Linker (39-55)
TSFLLPMGPSPPAEGST

SEQ ID NO: 3371 - protein, 16 aa, synthetic construct
  REGION 1..16: note = TNR1B Linker (40-55)
SFLLPMGPSPPAEGST

SEQ ID NO: 3372 - protein, 15 aa, synthetic construct
  REGION 1..15: note = TNR1B Linker (41-55)
FLLPMGPSPPAEGST

SEQ ID NO: 3373 - protein, 14 aa, synthetic construct
  REGION 1..14: note = TNR1B Linker (42-55)
LLPMGPSPPAEGST

SEQ ID NO: 3374 - protein, 13 aa, synthetic construct
  REGION 1..13: note = TNR1B Linker (43-55)
LPMGPSPPAEGST

SEQ ID NO: 3375 - protein, 12 aa, synthetic construct
  REGION 1..12: note = TNR1B Linker (44-55)
PMGPSPPAEGST

SEQ ID NO: 3376 - protein, 11 aa, synthetic construct
  REGION 1..11: note = TNR1B Linker (45-55)
MGPSPPAEGST

SEQ ID NO: 3377 - protein, 10 aa, synthetic construct
  REGION 1..10: note = TNR1B Linker (46-55)
GPSPPAEGST

SEQ ID NO: 3378 - protein, 9 aa, synthetic construct
  REGION 1..9: note = TNR1B Linker (47-55)
PSPPAEGST

SEQ ID NO: 3379 - protein, 8 aa, synthetic construct
  REGION 1..8: note = TNR1B Linker (48-55)
SPPAEGST

SEQ ID NO: 3380 - protein, 7 aa, synthetic construct
  REGION 1..7: note = TNR1B Linker (49-55)
PPAEGST

SEQ ID NO: 3381 - protein, 6 aa, synthetic construct
  REGION 1..6: note = TNR1B Linker (50-55)
PAEGST

SEQ ID NO: 3382 - protein, 5 aa, synthetic construct
  REGION 1..5: note = TNR1B Linker (51-55)
AEGST

SEQ ID NO: 3383 - protein, 54 aa, synthetic construct
  REGION 1..54: note = TNR1B Linker (1-54)
TSTSPTRSMAPGAVHLPQPVSTRSQHTQPTPEPSTAPSTSFLLPMGPSPPAEGS

SEQ ID NO: 3384 - protein, 53 aa, synthetic construct
  REGION 1..53: note = TNR1B Linker (2-54)
STSPTRSMAPGAVHLPQPVSTRSQHTQPTPEPSTAPSTSFLLPMGPSPPAEGS

SEQ ID NO: 3385 - protein, 52 aa, synthetic construct
  REGION 1..52: note = TNR1B Linker (3-54)
TSPTRSMAPGAVHLPQPVSTRSQHTQPTPEPSTAPSTSFLLPMGPSPPAEGS

SEQ ID NO: 3386 - protein, 51 aa, synthetic construct
  REGION 1..51: note = TNR1B Linker (4-54)
SPTRSMAPGAVHLPQPVSTRSQHTQPTPEPSTAPSTSFLLPMGPSPPAEGS

SEQ ID NO: 3387 - protein, 50 aa, synthetic construct
  REGION 1..50: note = TNR1B Linker (5-54)
PTRSMAPGAVHLPQPVSTRSQHTQPTPEPSTAPSTSFLLPMGPSPPAEGS

SEQ ID NO: 3388 - protein, 49 aa, synthetic construct
  REGION 1..49: note = TNR1B Linker (6-54)
TRSMAPGAVHLPQPVSTRSQHTQPTPEPSTAPSTSFLLPMGPSPPAEGS

SEQ ID NO: 3389 - protein, 48 aa, synthetic construct
  REGION 1..48: note = TNR1B Linker (7-54)
RSMAPGAVHLPQPVSTRSQHTQPTPEPSTAPSTSFLLPMGPSPPAEGS

SEQ ID NO: 3390 - protein, 47 aa, synthetic construct
  REGION 1..47: note = TNR1B Linker (8-54)
SMAPGAVHLPQPVSTRSQHTQPTPEPSTAPSTSFLLPMGPSPPAEGS

SEQ ID NO: 3391 - protein, 46 aa, synthetic construct
  REGION 1..46: note = TNR1B Linker (9-54)
MAPGAVHLPQPVSTRSQHTQPTPEPSTAPSTSFLLPMGPSPPAEGS

SEQ ID NO: 3392 - protein, 45 aa, synthetic construct
  REGION 1..45: note = TNR1B Linker (10-54)
APGAVHLPQPVSTRSQHTQPTPEPSTAPSTSFLLPMGPSPPAEGS

SEQ ID NO: 3393 - protein, 44 aa, synthetic construct
  REGION 1..44: note = TNR1B Linker (11-54)
PGAVHLPQPVSTRSQHTQPTPEPSTAPSTSFLLPMGPSPPAEGS

SEQ ID NO: 3394 - protein, 43 aa, synthetic construct
  REGION 1..43: note = TNR1B Linker (12-54)
GAVHLPQPVSTRSQHTQPTPEPSTAPSTSFLLPMGPSPPAEGS

SEQ ID NO: 3395 - protein, 42 aa, synthetic construct
  REGION 1..42: note = TNR1B Linker (13-54)
AVHLPQPVSTRSQHTQPTPEPSTAPSTSFLLPMGPSPPAEGS

SEQ ID NO: 3396 - protein, 41 aa, synthetic construct
  REGION 1..41: note = TNR1B Linker (14-54)
VHLPQPVSTRSQHTQPTPEPSTAPSTSFLLPMGPSPPAEGS

SEQ ID NO: 3397 - protein, 40 aa, synthetic construct
  REGION 1..40: note = TNR1B Linker (15-54)
HLPQPVSTRSQHTQPTPEPSTAPSTSFLLPMGPSPPAEGS

SEQ ID NO: 3398 - protein, 39 aa, synthetic construct
  REGION 1..39: note = TNR1B Linker (16-54)
LPQPVSTRSQHTQPTPEPSTAPSTSFLLPMGPSPPAEGS

SEQ ID NO: 3399 - protein, 38 aa, synthetic construct
  REGION 1..38: note = TNR1B Linker (17-54)
PQPVSTRSQHTQPTPEPSTAPSTSFLLPMGPSPPAEGS

SEQ ID NO: 3400 - protein, 37 aa, synthetic construct
  REGION 1..37: note = TNR1B Linker (18-54)
QPVSTRSQHTQPTPEPSTAPSTSFLLPMGPSPPAEGS

SEQ ID NO: 3401 - protein, 36 aa, synthetic construct
  REGION 1..36: note = TNR1B Linker (19-54)
PVSTRSQHTQPTPEPSTAPSTSFLLPMGPSPPAEGS

SEQ ID NO: 3402 - protein, 35 aa, synthetic construct
  REGION 1..35: note = TNR1B Linker (20-54)
VSTRSQHTQPTPEPSTAPSTSFLLPMGPSPPAEGS

SEQ ID NO: 3403 - protein, 34 aa, synthetic construct
  REGION 1..34: note = TNR1B Linker (21-54)
STRSQHTQPTPEPSTAPSTSFLLPMGPSPPAEGS

SEQ ID NO: 3404 - protein, 33 aa, synthetic construct
  REGION 1..33: note = TNR1B Linker (22-54)
TRSQHTQPTPEPSTAPSTSFLLPMGPSPPAEGS

SEQ ID NO: 3405 - protein, 32 aa, synthetic construct
  REGION 1..32: note = TNR1B Linker (23-54)
RSQHTQPTPEPSTAPSTSFLLPMGPSPPAEGS

SEQ ID NO: 3406 - protein, 31 aa, synthetic construct
  REGION 1..31: note = TNR1B Linker (24-54)
SQHTQPTPEPSTAPSTSFLLPMGPSPPAEGS

SEQ ID NO: 3407 - protein, 30 aa, synthetic construct
  REGION 1..30: note = TNR1B Linker (25-54)
QHTQPTPEPSTAPSTSFLLPMGPSPPAEGS

SEQ ID NO: 3408 - protein, 29 aa, synthetic construct
  REGION 1..29: note = TNR1B Linker (26-54)
HTQPTPEPSTAPSTSFLLPMGPSPPAEGS

SEQ ID NO: 3409 - protein, 28 aa, synthetic construct
  REGION 1..28: note = TNR1B Linker (27-54)
TQPTPEPSTAPSTSFLLPMGPSPPAEGS

SEQ ID NO: 3410 - protein, 27 aa, synthetic construct
  REGION 1..27: note = TNR1B Linker (28-54)
QPTPEPSTAPSTSFLLPMGPSPPAEGS

SEQ ID NO: 3411 - protein, 26 aa, synthetic construct
  REGION 1..26: note = TNR1B Linker (29-54)
PTPEPSTAPSTSFLLPMGPSPPAEGS

SEQ ID NO: 3412 - protein, 25 aa, synthetic construct
  REGION 1..25: note = TNR1B Linker (30-54)
TPEPSTAPSTSFLLPMGPSPPAEGS

SEQ ID NO: 3413 - protein, 24 aa, synthetic construct
  REGION 1..24: note = TNR1B Linker (31-54)
PEPSTAPSTSFLLPMGPSPPAEGS

SEQ ID NO: 3414 - protein, 23 aa, synthetic construct
  REGION 1..23: note = TNR1B Linker (32-54)
EPSTAPSTSFLLPMGPSPPAEGS

SEQ ID NO: 3415 - protein, 22 aa, synthetic construct
  REGION 1..22: note = TNR1B Linker (33-54)
PSTAPSTSFLLPMGPSPPAEGS

SEQ ID NO: 3416 - protein, 21 aa, synthetic construct
  REGION 1..21: note = TNR1B Linker (34-54)
STAPSTSFLLPMGPSPPAEGS

SEQ ID NO: 3417 - protein, 20 aa, synthetic construct
  REGION 1..20: note = TNR1B Linker (35-54)
TAPSTSFLLPMGPSPPAEGS

SEQ ID NO: 3418 - protein, 19 aa, synthetic construct
  REGION 1..19: note = TNR1B Linker (36-54)
APSTSFLLPMGPSPPAEGS

SEQ ID NO: 3419 - protein, 18 aa, synthetic construct
  REGION 1..18: note = TNR1B Linker (37-54)
PSTSFLLPMGPSPPAEGS

SEQ ID NO: 3420 - protein, 17 aa, synthetic construct
  REGION 1..17: note = TNR1B Linker (38-54)
STSFLLPMGPSPPAEGS

SEQ ID NO: 3421 - protein, 16 aa, synthetic construct
  REGION 1..16: note = TNR1B Linker (39-54)
TSFLLPMGPSPPAEGS

SEQ ID NO: 3422 - protein, 15 aa, synthetic construct
  REGION 1..15: note = TNR1B Linker (40-54)
SFLLPMGPSPPAEGS

SEQ ID NO: 3423 - protein, 14 aa, synthetic construct
  REGION 1..14: note = TNR1B Linker (41-54)
FLLPMGPSPPAEGS

SEQ ID NO: 3424 - protein, 13 aa, synthetic construct
  REGION 1..13: note = TNR1B Linker (42-54)
LLPMGPSPPAEGS

SEQ ID NO: 3425 - protein, 12 aa, synthetic construct
  REGION 1..12: note = TNR1B Linker (43-54)
LPMGPSPPAEGS

SEQ ID NO: 3426 - protein, 11 aa, synthetic construct
  REGION 1..11: note = TNR1B Linker (44-54)
PMGPSPPAEGS

SEQ ID NO: 3427 - protein, 10 aa, synthetic construct
  REGION 1..10: note = TNR1B Linker (45-54)
MGPSPPAEGS

SEQ ID NO: 3428 - protein, 9 aa, synthetic construct
  REGION 1..9: note = TNR1B Linker (46-54)
GPSPPAEGS

SEQ ID NO: 3429 - protein, 8 aa, synthetic construct
  REGION 1..8: note = TNR1B Linker (47-54)
PSPPAEGS

SEQ ID NO: 3430 - protein, 7 aa, synthetic construct
  REGION 1..7: note = TNR1B Linker (48-54)
SPPAEGS

SEQ ID NO: 3431 - protein, 6 aa, synthetic construct
  REGION 1..6: note = TNR1B Linker (49-54)
PPAEGS

SEQ ID NO: 3432 - protein, 5 aa, synthetic construct
  REGION 1..5: note = TNR1B Linker (50-54)
PAEGS

SEQ ID NO: 3433 - protein, 53 aa, synthetic construct
  REGION 1..53: note = TNR1B Linker (1-53)
TSTSPTRSMAPGAVHLPQPVSTRSQHTQPTPEPSTAPSTSFLLPMGPSPPAEG

SEQ ID NO: 3434 - protein, 52 aa, synthetic construct
  REGION 1..52: note = TNR1B Linker (2-53)
STSPTRSMAPGAVHLPQPVSTRSQHTQPTPEPSTAPSTSFLLPMGPSPPAEG

SEQ ID NO: 3435 - protein, 51 aa, synthetic construct
  REGION 1..51: note = TNR1B Linker (3-53)
TSPTRSMAPGAVHLPQPVSTRSQHTQPTPEPSTAPSTSFLLPMGPSPPAEG

SEQ ID NO: 3436 - protein, 50 aa, synthetic construct
  REGION 1..50: note = TNR1B Linker (4-53)
SPTRSMAPGAVHLPQPVSTRSQHTQPTPEPSTAPSTSFLLPMGPSPPAEG

SEQ ID NO: 3437 - protein, 49 aa, synthetic construct
  REGION 1..49: note = TNR1B Linker (5-53)
PTRSMAPGAVHLPQPVSTRSQHTQPTPEPSTAPSTSFLLPMGPSPPAEG

SEQ ID NO: 3438 - protein, 48 aa, synthetic construct
  REGION 1..48: note = TNR1B Linker (6-53)
TRSMAPGAVHLPQPVSTRSQHTQPTPEPSTAPSTSFLLPMGPSPPAEG

SEQ ID NO: 3439 - protein, 47 aa, synthetic construct
  REGION 1..47: note = TNR1B Linker (7-53)
RSMAPGAVHLPQPVSTRSQHTQPTPEPSTAPSTSFLLPMGPSPPAEG

SEQ ID NO: 3440 - protein, 46 aa, synthetic construct
  REGION 1..46: note = TNR1B Linker (8-53)
SMAPGAVHLPQPVSTRSQHTQPTPEPSTAPSTSFLLPMGPSPPAEG

SEQ ID NO: 3441 - protein, 45 aa, synthetic construct
  REGION 1..45: note = TNR1B Linker (9-53)
MAPGAVHLPQPVSTRSQHTQPTPEPSTAPSTSFLLPMGPSPPAEG

SEQ ID NO: 3442 - protein, 44 aa, synthetic construct
  REGION 1..44: note = TNR1B Linker (10-53)
APGAVHLPQPVSTRSQHTQPTPEPSTAPSTSFLLPMGPSPPAEG

SEQ ID NO: 3443 - protein, 43 aa, synthetic construct
  REGION 1..43: note = TNR1B Linker (11-53)
PGAVHLPQPVSTRSQHTQPTPEPSTAPSTSFLLPMGPSPPAEG

SEQ ID NO: 3444 - protein, 42 aa, synthetic construct
  REGION 1..42: note = TNR1B Linker (12-53)
GAVHLPQPVSTRSQHTQPTPEPSTAPSTSFLLPMGPSPPAEG

SEQ ID NO: 3445 - protein, 41 aa, synthetic construct
  REGION 1..41: note = TNR1B Linker (13-53)
AVHLPQPVSTRSQHTQPTPEPSTAPSTSFLLPMGPSPPAEG

SEQ ID NO: 3446 - protein, 40 aa, synthetic construct
  REGION 1..40: note = TNR1B Linker (14-53)
VHLPQPVSTRSQHTQPTPEPSTAPSTSFLLPMGPSPPAEG

SEQ ID NO: 3447 - protein, 39 aa, synthetic construct
  REGION 1..39: note = TNR1B Linker (15-53)
HLPQPVSTRSQHTQPTPEPSTAPSTSFLLPMGPSPPAEG

SEQ ID NO: 3448 - protein, 38 aa, synthetic construct
  REGION 1..38: note = TNR1B Linker (16-53)
LPQPVSTRSQHTQPTPEPSTAPSTSFLLPMGPSPPAEG

SEQ ID NO: 3449 - protein, 37 aa, synthetic construct
  REGION 1..37: note = TNR1B Linker (17-53)
PQPVSTRSQHTQPTPEPSTAPSTSFLLPMGPSPPAEG

SEQ ID NO: 3450 - protein, 36 aa, synthetic construct
  REGION 1..36: note = TNR1B Linker (18-53)
QPVSTRSQHTQPTPEPSTAPSTSFLLPMGPSPPAEG

SEQ ID NO: 3451 - protein, 35 aa, synthetic construct
  REGION 1..35: note = TNR1B Linker (19-53)
PVSTRSQHTQPTPEPSTAPSTSFLLPMGPSPPAEG

SEQ ID NO: 3452 - protein, 34 aa, synthetic construct
  REGION 1..34: note = TNR1B Linker (20-53)
VSTRSQHTQPTPEPSTAPSTSFLLPMGPSPPAEG

SEQ ID NO: 3453 - protein, 33 aa, synthetic construct
  REGION 1..33: note = TNR1B Linker (21-53)
STRSQHTQPTPEPSTAPSTSFLLPMGPSPPAEG

SEQ ID NO: 3454 - protein, 32 aa, synthetic construct
  REGION 1..32: note = TNR1B Linker (22-53)
TRSQHTQPTPEPSTAPSTSFLLPMGPSPPAEG

SEQ ID NO: 3455 - protein, 31 aa, synthetic construct
  REGION 1..31: note = TNR1B Linker (23-53)
RSQHTQPTPEPSTAPSTSFLLPMGPSPPAEG

SEQ ID NO: 3456 - protein, 30 aa, synthetic construct
  REGION 1..30: note = TNR1B Linker (24-53)
SQHTQPTPEPSTAPSTSFLLPMGPSPPAEG

SEQ ID NO: 3457 - protein, 29 aa, synthetic construct
  REGION 1..29: note = TNR1B Linker (25-53)
QHTQPTPEPSTAPSTSFLLPMGPSPPAEG

SEQ ID NO: 3458 - protein, 28 aa, synthetic construct
  REGION 1..28: note = TNR1B Linker (26-53)
HTQPTPEPSTAPSTSFLLPMGPSPPAEG

SEQ ID NO: 3459 - protein, 27 aa, synthetic construct
  REGION 1..27: note = TNR1B Linker (27-53)
TQPTPEPSTAPSTSFLLPMGPSPPAEG

SEQ ID NO: 3460 - protein, 26 aa, synthetic construct
  REGION 1..26: note = TNR1B Linker (28-53)
QPTPEPSTAPSTSFLLPMGPSPPAEG

SEQ ID NO: 3461 - protein, 25 aa, synthetic construct
  REGION 1..25: note = TNR1B Linker (29-53)
PTPEPSTAPSTSFLLPMGPSPPAEG

SEQ ID NO: 3462 - protein, 24 aa, synthetic construct
  REGION 1..24: note = TNR1B Linker (30-53)
TPEPSTAPSTSFLLPMGPSPPAEG

SEQ ID NO: 3463 - protein, 23 aa, synthetic construct
  REGION 1..23: note = TNR1B Linker (31-53)
PEPSTAPSTSFLLPMGPSPPAEG

SEQ ID NO: 3464 - protein, 22 aa, synthetic construct
  REGION 1..22: note = TNR1B Linker (32-53)
EPSTAPSTSFLLPMGPSPPAEG

SEQ ID NO: 3465 - protein, 21 aa, synthetic construct
  REGION 1..21: note = TNR1B Linker (33-53)
PSTAPSTSFLLPMGPSPPAEG

SEQ ID NO: 3466 - protein, 20 aa, synthetic construct
  REGION 1..20: note = TNR1B Linker (34-53)
STAPSTSFLLPMGPSPPAEG

SEQ ID NO: 3467 - protein, 19 aa, synthetic construct
  REGION 1..19: note = TNR1B Linker (35-53)
TAPSTSFLLPMGPSPPAEG

SEQ ID NO: 3468 - protein, 18 aa, synthetic construct
  REGION 1..18: note = TNR1B Linker (36-53)
APSTSFLLPMGPSPPAEG

SEQ ID NO: 3469 - protein, 17 aa, synthetic construct
  REGION 1..17: note = TNR1B Linker (37-53)
PSTSFLLPMGPSPPAEG

SEQ ID NO: 3470 - protein, 16 aa, synthetic construct
  REGION 1..16: note = TNR1B Linker (38-53)
STSFLLPMGPSPPAEG

SEQ ID NO: 3471 - protein, 15 aa, synthetic construct
  REGION 1..15: note = TNR1B Linker (39-53)
TSFLLPMGPSPPAEG

SEQ ID NO: 3472 - protein, 14 aa, synthetic construct
  REGION 1..14: note = TNR1B Linker (40-53)
SFLLPMGPSPPAEG

SEQ ID NO: 3473 - protein, 13 aa, synthetic construct
  REGION 1..13: note = TNR1B Linker (41-53)
FLLPMGPSPPAEG

SEQ ID NO: 3474 - protein, 12 aa, synthetic construct
  REGION 1..12: note = TNR1B Linker (42-53)
LLPMGPSPPAEG

SEQ ID NO: 3475 - protein, 11 aa, synthetic construct
  REGION 1..11: note = TNR1B Linker (43-53)
LPMGPSPPAEG

SEQ ID NO: 3476 - protein, 10 aa, synthetic construct
  REGION 1..10: note = TNR1B Linker (44-53)
PMGPSPPAEG

SEQ ID NO: 3477 - protein, 9 aa, synthetic construct
  REGION 1..9: note = TNR1B Linker (45-53)
MGPSPPAEG

SEQ ID NO: 3478 - protein, 8 aa, synthetic construct
  REGION 1..8: note = TNR1B Linker (46-53)
GPSPPAEG

SEQ ID NO: 3479 - protein, 7 aa, synthetic construct
  REGION 1..7: note = TNR1B Linker (47-53)
PSPPAEG

SEQ ID NO: 3480 - protein, 6 aa, synthetic construct
  REGION 1..6: note = TNR1B Linker (48-53)
SPPAEG

SEQ ID NO: 3481 - protein, 5 aa, synthetic construct
  REGION 1..5: note = TNR1B Linker (49-53)
PPAEG

SEQ ID NO: 3482 - protein, 52 aa, synthetic construct
  REGION 1..52: note = TNR1B Linker (1-52)
TSTSPTRSMAPGAVHLPQPVSTRSQHTQPTPEPSTAPSTSFLLPMGPSPPAE

SEQ ID NO: 3483 - protein, 51 aa, synthetic construct
  REGION 1..51: note = TNR1B Linker (2-52)
STSPTRSMAPGAVHLPQPVSTRSQHTQPTPEPSTAPSTSFLLPMGPSPPAE

SEQ ID NO: 3484 - protein, 50 aa, synthetic construct
  REGION 1..50: note = TNR1B Linker (3-52)
TSPTRSMAPGAVHLPQPVSTRSQHTQPTPEPSTAPSTSFLLPMGPSPPAE

SEQ ID NO: 3485 - protein, 49 aa, synthetic construct
  REGION 1..49: note = TNR1B Linker (4-52)
SPTRSMAPGAVHLPQPVSTRSQHTQPTPEPSTAPSTSFLLPMGPSPPAE

SEQ ID NO: 3486 - protein, 48 aa, synthetic construct
  REGION 1..48: note = TNR1B Linker (5-52)
PTRSMAPGAVHLPQPVSTRSQHTQPTPEPSTAPSTSFLLPMGPSPPAE

SEQ ID NO: 3487 - protein, 47 aa, synthetic construct
  REGION 1..47: note = TNR1B Linker (6-52)
TRSMAPGAVHLPQPVSTRSQHTQPTPEPSTAPSTSFLLPMGPSPPAE

SEQ ID NO: 3488 - protein, 46 aa, synthetic construct
  REGION 1..46: note = TNR1B Linker (7-52)
RSMAPGAVHLPQPVSTRSQHTQPTPEPSTAPSTSFLLPMGPSPPAE

SEQ ID NO: 3489 - protein, 45 aa, synthetic construct
  REGION 1..45: note = TNR1B Linker (8-52)
SMAPGAVHLPQPVSTRSQHTQPTPEPSTAPSTSFLLPMGPSPPAE

SEQ ID NO: 3490 - protein, 44 aa, synthetic construct
  REGION 1..44: note = TNR1B Linker (9-52)
MAPGAVHLPQPVSTRSQHTQPTPEPSTAPSTSFLLPMGPSPPAE

SEQ ID NO: 3491 - protein, 43 aa, synthetic construct
  REGION 1..43: note = TNR1B Linker (10-52)
APGAVHLPQPVSTRSQHTQPTPEPSTAPSTSFLLPMGPSPPAE

SEQ ID NO: 3492 - protein, 42 aa, synthetic construct
  REGION 1..42: note = TNR1B Linker (11-52)
PGAVHLPQPVSTRSQHTQPTPEPSTAPSTSFLLPMGPSPPAE

SEQ ID NO: 3493 - protein, 41 aa, synthetic construct
  REGION 1..41: note = TNR1B Linker (12-52)
GAVHLPQPVSTRSQHTQPTPEPSTAPSTSFLLPMGPSPPAE

SEQ ID NO: 3494 - protein, 40 aa, synthetic construct
  REGION 1..40: note = TNR1B Linker (13-52)
AVHLPQPVSTRSQHTQPTPEPSTAPSTSFLLPMGPSPPAE

SEQ ID NO: 3495 - protein, 39 aa, synthetic construct
  REGION 1..39: note = TNR1B Linker (14-52)
VHLPQPVSTRSQHTQPTPEPSTAPSTSFLLPMGPSPPAE

SEQ ID NO: 3496 - protein, 38 aa, synthetic construct
  REGION 1..38: note = TNR1B Linker (15-52)
HLPQPVSTRSQHTQPTPEPSTAPSTSFLLPMGPSPPAE

SEQ ID NO: 3497 - protein, 37 aa, synthetic construct
  REGION 1..37: note = TNR1B Linker (16-52)
LPQPVSTRSQHTQPTPEPSTAPSTSFLLPMGPSPPAE

SEQ ID NO: 3498 - protein, 36 aa, synthetic construct
  REGION 1..36: note = TNR1B Linker (17-52)
PQPVSTRSQHTQPTPEPSTAPSTSFLLPMGPSPPAE

SEQ ID NO: 3499 - protein, 35 aa, synthetic construct
  REGION 1..35: note = TNR1B Linker (18-52)
QPVSTRSQHTQPTPEPSTAPSTSFLLPMGPSPPAE

SEQ ID NO: 3500 - protein, 34 aa, synthetic construct
  REGION 1..34: note = TNR1B Linker (19-52)
PVSTRSQHTQPTPEPSTAPSTSFLLPMGPSPPAE

SEQ ID NO: 3501 - protein, 33 aa, synthetic construct
  REGION 1..33: note = TNR1B Linker (20-52)
VSTRSQHTQPTPEPSTAPSTSFLLPMGPSPPAE

SEQ ID NO: 3502 - protein, 32 aa, synthetic construct
  REGION 1..32: note = TNR1B Linker (21-52)
STRSQHTQPTPEPSTAPSTSFLLPMGPSPPAE

SEQ ID NO: 3503 - protein, 31 aa, synthetic construct
  REGION 1..31: note = TNR1B Linker (22-52)
TRSQHTQPTPEPSTAPSTSFLLPMGPSPPAE

SEQ ID NO: 3504 - protein, 30 aa, synthetic construct
  REGION 1..30: note = TNR1B Linker (23-52)
RSQHTQPTPEPSTAPSTSFLLPMGPSPPAE

SEQ ID NO: 3505 - protein, 29 aa, synthetic construct
  REGION 1..29: note = TNR1B Linker (24-52)
SQHTQPTPEPSTAPSTSFLLPMGPSPPAE

SEQ ID NO: 3506 - protein, 28 aa, synthetic construct
  REGION 1..28: note = TNR1B Linker (25-52)
QHTQPTPEPSTAPSTSFLLPMGPSPPAE

SEQ ID NO: 3507 - protein, 27 aa, synthetic construct
  REGION 1..27: note = TNR1B Linker (26-52)
HTQPTPEPSTAPSTSFLLPMGPSPPAE

SEQ ID NO: 3508 - protein, 26 aa, synthetic construct
  REGION 1..26: note = TNR1B Linker (27-52)
TQPTPEPSTAPSTSFLLPMGPSPPAE

SEQ ID NO: 3509 - protein, 25 aa, synthetic construct
  REGION 1..25: note = TNR1B Linker (28-52)
QPTPEPSTAPSTSFLLPMGPSPPAE

SEQ ID NO: 3510 - protein, 24 aa, synthetic construct
  REGION 1..24: note = TNR1B Linker (29-52)
PTPEPSTAPSTSFLLPMGPSPPAE

SEQ ID NO: 3511 - protein, 23 aa, synthetic construct
  REGION 1..23: note = TNR1B Linker (30-52)
TPEPSTAPSTSFLLPMGPSPPAE

SEQ ID NO: 3512 - protein, 22 aa, synthetic construct
  REGION 1..22: note = TNR1B Linker (31-52)
PEPSTAPSTSFLLPMGPSPPAE

SEQ ID NO: 3513 - protein, 21 aa, synthetic construct
  REGION 1..21: note = TNR1B Linker (32-52)
EPSTAPSTSFLLPMGPSPPAE

SEQ ID NO: 3514 - protein, 20 aa, synthetic construct
  REGION 1..20: note = TNR1B Linker (33-52)
PSTAPSTSFLLPMGPSPPAE

SEQ ID NO: 3515 - protein, 19 aa, synthetic construct
  REGION 1..19: note = TNR1B Linker (34-52)
STAPSTSFLLPMGPSPPAE

SEQ ID NO: 3516 - protein, 18 aa, synthetic construct
  REGION 1..18: note = TNR1B Linker (35-52)
TAPSTSFLLPMGPSPPAE

SEQ ID NO: 3517 - protein, 17 aa, synthetic construct
  REGION 1..17: note = TNR1B Linker (36-52)
APSTSFLLPMGPSPPAE

SEQ ID NO: 3518 - protein, 16 aa, synthetic construct
  REGION 1..16: note = TNR1B Linker (37-52)
PSTSFLLPMGPSPPAE

SEQ ID NO: 3519 - protein, 15 aa, synthetic construct
  REGION 1..15: note = TNR1B Linker (38-52)
STSFLLPMGPSPPAE

SEQ ID NO: 3520 - protein, 14 aa, synthetic construct
  REGION 1..14: note = TNR1B Linker (39-52)
TSFLLPMGPSPPAE

SEQ ID NO: 3521 - protein, 13 aa, synthetic construct
  REGION 1..13: note = TNR1B Linker (40-52)
SFLLPMGPSPPAE

SEQ ID NO: 3522 - protein, 12 aa, synthetic construct
  REGION 1..12: note = TNR1B Linker (41-52)
FLLPMGPSPPAE

SEQ ID NO: 3523 - protein, 11 aa, synthetic construct
  REGION 1..11: note = TNR1B Linker (42-52)
LLPMGPSPPAE

SEQ ID NO: 3524 - protein, 10 aa, synthetic construct
  REGION 1..10: note = TNR1B Linker (43-52)
LPMGPSPPAE

SEQ ID NO: 3525 - protein, 9 aa, synthetic construct
  REGION 1..9: note = TNR1B Linker (44-52)
PMGPSPPAE

SEQ ID NO: 3526 - protein, 8 aa, synthetic construct
  REGION 1..8: note = TNR1B Linker (45-52)
MGPSPPAE

SEQ ID NO: 3527 - protein, 7 aa, synthetic construct
  REGION 1..7: note = TNR1B Linker (46-52)
GPSPPAE

SEQ ID NO: 3528 - protein, 6 aa, synthetic construct
  REGION 1..6: note = TNR1B Linker (47-52)
PSPPAE

SEQ ID NO: 3529 - protein, 5 aa, synthetic construct
  REGION 1..5: note = TNR1B Linker (48-52)
SPPAE

SEQ ID NO: 3530 - protein, 51 aa, synthetic construct
  REGION 1..51: note = TNR1B Linker (1-51)
TSTSPTRSMAPGAVHLPQPVSTRSQHTQPTPEPSTAPSTSFLLPMGPSPPA

SEQ ID NO: 3531 - protein, 50 aa, synthetic construct
  REGION 1..50: note = TNR1B Linker (2-51)
STSPTRSMAPGAVHLPQPVSTRSQHTQPTPEPSTAPSTSFLLPMGPSPPA

SEQ ID NO: 3532 - protein, 49 aa, synthetic construct
  REGION 1..49: note = TNR1B Linker (3-51)
TSPTRSMAPGAVHLPQPVSTRSQHTQPTPEPSTAPSTSFLLPMGPSPPA

SEQ ID NO: 3533 - protein, 48 aa, synthetic construct
  REGION 1..48: note = TNR1B Linker (4-51)
SPTRSMAPGAVHLPQPVSTRSQHTQPTPEPSTAPSTSFLLPMGPSPPA

SEQ ID NO: 3534 - protein, 47 aa, synthetic construct
  REGION 1..47: note = TNR1B Linker (5-51)
PTRSMAPGAVHLPQPVSTRSQHTQPTPEPSTAPSTSFLLPMGPSPPA

SEQ ID NO: 3535 - protein, 46 aa, synthetic construct
  REGION 1..46: note = TNR1B Linker (6-51)
TRSMAPGAVHLPQPVSTRSQHTQPTPEPSTAPSTSFLLPMGPSPPA

SEQ ID NO: 3536 - protein, 45 aa, synthetic construct
  REGION 1..45: note = TNR1B Linker (7-51)
RSMAPGAVHLPQPVSTRSQHTQPTPEPSTAPSTSFLLPMGPSPPA

SEQ ID NO: 3537 - protein, 44 aa, synthetic construct
  REGION 1..44: note = TNR1B Linker (8-51)
SMAPGAVHLPQPVSTRSQHTQPTPEPSTAPSTSFLLPMGPSPPA

SEQ ID NO: 3538 - protein, 43 aa, synthetic construct
  REGION 1..43: note = TNR1B Linker (9-51)
MAPGAVHLPQPVSTRSQHTQPTPEPSTAPSTSFLLPMGPSPPA

SEQ ID NO: 3539 - protein, 42 aa, synthetic construct
  REGION 1..42: note = TNR1B Linker (10-51)
APGAVHLPQPVSTRSQHTQPTPEPSTAPSTSFLLPMGPSPPA

SEQ ID NO: 3540 - protein, 41 aa, synthetic construct
  REGION 1..41: note = TNR1B Linker (11-51)
PGAVHLPQPVSTRSQHTQPTPEPSTAPSTSFLLPMGPSPPA

SEQ ID NO: 3541 - protein, 40 aa, synthetic construct
  REGION 1..40: note = TNR1B Linker (12-51)
GAVHLPQPVSTRSQHTQPTPEPSTAPSTSFLLPMGPSPPA

SEQ ID NO: 3542 - protein, 39 aa, synthetic construct
  REGION 1..39: note = TNR1B Linker (13-51)
AVHLPQPVSTRSQHTQPTPEPSTAPSTSFLLPMGPSPPA

SEQ ID NO: 3543 - protein, 38 aa, synthetic construct
  REGION 1..38: note = TNR1B Linker (14-51)
VHLPQPVSTRSQHTQPTPEPSTAPSTSFLLPMGPSPPA

SEQ ID NO: 3544 - protein, 37 aa, synthetic construct
  REGION 1..37: note = TNR1B Linker (15-51)
HLPQPVSTRSQHTQPTPEPSTAPSTSFLLPMGPSPPA

SEQ ID NO: 3545 - protein, 36 aa, synthetic construct
  REGION 1..36: note = TNR1B Linker (16-51)
LPQPVSTRSQHTQPTPEPSTAPSTSFLLPMGPSPPA

SEQ ID NO: 3546 - protein, 35 aa, synthetic construct
  REGION 1..35: note = TNR1B Linker (17-51)
PQPVSTRSQHTQPTPEPSTAPSTSFLLPMGPSPPA

SEQ ID NO: 3547 - protein, 34 aa, synthetic construct
  REGION 1..34: note = TNR1B Linker (18-51)
QPVSTRSQHTQPTPEPSTAPSTSFLLPMGPSPPA

SEQ ID NO: 3548 - protein, 33 aa, synthetic construct
  REGION 1..33: note = TNR1B Linker (19-51)
PVSTRSQHTQPTPEPSTAPSTSFLLPMGPSPPA

SEQ ID NO: 3549 - protein, 32 aa, synthetic construct
  REGION 1..32: note = TNR1B Linker (20-51)
VSTRSQHTQPTPEPSTAPSTSFLLPMGPSPPA

SEQ ID NO: 3550 - protein, 31 aa, synthetic construct
  REGION 1..31: note = TNR1B Linker (21-51)
STRSQHTQPTPEPSTAPSTSFLLPMGPSPPA

SEQ ID NO: 3551 - protein, 30 aa, synthetic construct
  REGION 1..30: note = TNR1B Linker (22-51)
TRSQHTQPTPEPSTAPSTSFLLPMGPSPPA

SEQ ID NO: 3552 - protein, 29 aa, synthetic construct
  REGION 1..29: note = TNR1B Linker (23-51)
RSQHTQPTPEPSTAPSTSFLLPMGPSPPA

SEQ ID NO: 3553 - protein, 28 aa, synthetic construct
  REGION 1..28: note = TNR1B Linker (24-51)
SQHTQPTPEPSTAPSTSFLLPMGPSPPA

SEQ ID NO: 3554 - protein, 27 aa, synthetic construct
  REGION 1..27: note = TNR1B Linker (25-51)
QHTQPTPEPSTAPSTSFLLPMGPSPPA

SEQ ID NO: 3555 - protein, 26 aa, synthetic construct
  REGION 1..26: note = TNR1B Linker (26-51)
HTQPTPEPSTAPSTSFLLPMGPSPPA

SEQ ID NO: 3556 - protein, 25 aa, synthetic construct
  REGION 1..25: note = TNR1B Linker (27-51)
TQPTPEPSTAPSTSFLLPMGPSPPA

SEQ ID NO: 3557 - protein, 24 aa, synthetic construct
  REGION 1..24: note = TNR1B Linker (28-51)
QPTPEPSTAPSTSFLLPMGPSPPA

SEQ ID NO: 3558 - protein, 23 aa, synthetic construct
  REGION 1..23: note = TNR1B Linker (29-51)
PTPEPSTAPSTSFLLPMGPSPPA

SEQ ID NO: 3559 - protein, 22 aa, synthetic construct
  REGION 1..22: note = TNR1B Linker (30-51)
TPEPSTAPSTSFLLPMGPSPPA

SEQ ID NO: 3560 - protein, 21 aa, synthetic construct
  REGION 1..21: note = TNR1B Linker (31-51)
PEPSTAPSTSFLLPMGPSPPA

SEQ ID NO: 3561 - protein, 20 aa, synthetic construct
  REGION 1..20: note = TNR1B Linker (32-51)
EPSTAPSTSFLLPMGPSPPA

SEQ ID NO: 3562 - protein, 19 aa, synthetic construct
  REGION 1..19: note = TNR1B Linker (33-51)
PSTAPSTSFLLPMGPSPPA

SEQ ID NO: 3563 - protein, 18 aa, synthetic construct
  REGION 1..18: note = TNR1B Linker (34-51)
STAPSTSFLLPMGPSPPA

SEQ ID NO: 3564 - protein, 17 aa, synthetic construct
  REGION 1..17: note = TNR1B Linker (35-51)
TAPSTSFLLPMGPSPPA

SEQ ID NO: 3565 - protein, 16 aa, synthetic construct
  REGION 1..16: note = TNR1B Linker (36-51)
APSTSFLLPMGPSPPA

SEQ ID NO: 3566 - protein, 15 aa, synthetic construct
  REGION 1..15: note = TNR1B Linker (37-51)
PSTSFLLPMGPSPPA

SEQ ID NO: 3567 - protein, 14 aa, synthetic construct
  REGION 1..14: note = TNR1B Linker (38-51)
STSFLLPMGPSPPA

SEQ ID NO: 3568 - protein, 13 aa, synthetic construct
  REGION 1..13: note = TNR1B Linker (39-51)
TSFLLPMGPSPPA

SEQ ID NO: 3569 - protein, 12 aa, synthetic construct
  REGION 1..12: note = TNR1B Linker (40-51)
SFLLPMGPSPPA

SEQ ID NO: 3570 - protein, 11 aa, synthetic construct
  REGION 1..11: note = TNR1B Linker (41-51)
FLLPMGPSPPA

SEQ ID NO: 3571 - protein, 10 aa, synthetic construct
  REGION 1..10: note = TNR1B Linker (42-51)
LLPMGPSPPA

SEQ ID NO: 3572 - protein, 9 aa, synthetic construct
  REGION 1..9: note = TNR1B Linker (43-51)
LPMGPSPPA

SEQ ID NO: 3573 - protein, 8 aa, synthetic construct
  REGION 1..8: note = TNR1B Linker (44-51)
PMGPSPPA

SEQ ID NO: 3574 - protein, 7 aa, synthetic construct
  REGION 1..7: note = TNR1B Linker (45-51)
MGPSPPA

SEQ ID NO: 3575 - protein, 6 aa, synthetic construct
  REGION 1..6: note = TNR1B Linker (46-51)
GPSPPA

SEQ ID NO: 3576 - protein, 5 aa, synthetic construct
  REGION 1..5: note = TNR1B Linker (47-51)
PSPPA

SEQ ID NO: 3577 - protein, 50 aa, synthetic construct
  REGION 1..50: note = TNR1B Linker (1-50)
TSTSPTRSMAPGAVHLPQPVSTRSQHTQPTPEPSTAPSTSFLLPMGPSPP

SEQ ID NO: 3578 - protein, 49 aa, synthetic construct
  REGION 1..49: note = TNR1B Linker (2-50)
STSPTRSMAPGAVHLPQPVSTRSQHTQPTPEPSTAPSTSFLLPMGPSPP

SEQ ID NO: 3579 - protein, 48 aa, synthetic construct
  REGION 1..48: note = TNR1B Linker (3-50)
TSPTRSMAPGAVHLPQPVSTRSQHTQPTPEPSTAPSTSFLLPMGPSPP

SEQ ID NO: 3580 - protein, 47 aa, synthetic construct
  REGION 1..47: note = TNR1B Linker (4-50)
SPTRSMAPGAVHLPQPVSTRSQHTQPTPEPSTAPSTSFLLPMGPSPP

SEQ ID NO: 3581 - protein, 46 aa, synthetic construct
  REGION 1..46: note = TNR1B Linker (5-50)
PTRSMAPGAVHLPQPVSTRSQHTQPTPEPSTAPSTSFLLPMGPSPP

SEQ ID NO: 3582 - protein, 45 aa, synthetic construct
  REGION 1..45: note = TNR1B Linker (6-50)
TRSMAPGAVHLPQPVSTRSQHTQPTPEPSTAPSTSFLLPMGPSPP

SEQ ID NO: 3583 - protein, 44 aa, synthetic construct
  REGION 1..44: note = TNR1B Linker (7-50)
RSMAPGAVHLPQPVSTRSQHTQPTPEPSTAPSTSFLLPMGPSPP

SEQ ID NO: 3584 - protein, 43 aa, synthetic construct
  REGION 1..43: note = TNR1B Linker (8-50)
SMAPGAVHLPQPVSTRSQHTQPTPEPSTAPSTSFLLPMGPSPP

SEQ ID NO: 3585 - protein, 42 aa, synthetic construct
  REGION 1..42: note = TNR1B Linker (9-50)
MAPGAVHLPQPVSTRSQHTQPTPEPSTAPSTSFLLPMGPSPP

SEQ ID NO: 3586 - protein, 41 aa, synthetic construct
  REGION 1..41: note = TNR1B Linker (10-50)
APGAVHLPQPVSTRSQHTQPTPEPSTAPSTSFLLPMGPSPP

SEQ ID NO: 3587 - protein, 40 aa, synthetic construct
  REGION 1..40: note = TNR1B Linker (11-50)
PGAVHLPQPVSTRSQHTQPTPEPSTAPSTSFLLPMGPSPP

SEQ ID NO: 3588 - protein, 39 aa, synthetic construct
  REGION 1..39: note = TNR1B Linker (12-50)
GAVHLPQPVSTRSQHTQPTPEPSTAPSTSFLLPMGPSPP

SEQ ID NO: 3589 - protein, 38 aa, synthetic construct
  REGION 1..38: note = TNR1B Linker (13-50)
AVHLPQPVSTRSQHTQPTPEPSTAPSTSFLLPMGPSPP

SEQ ID NO: 3590 - protein, 37 aa, synthetic construct
  REGION 1..37: note = TNR1B Linker (14-50)
VHLPQPVSTRSQHTQPTPEPSTAPSTSFLLPMGPSPP

SEQ ID NO: 3591 - protein, 36 aa, synthetic construct
  REGION 1..36: note = TNR1B Linker (15-50)
HLPQPVSTRSQHTQPTPEPSTAPSTSFLLPMGPSPP

SEQ ID NO: 3592 - protein, 35 aa, synthetic construct
  REGION 1..35: note = TNR1B Linker (16-50)
LPQPVSTRSQHTQPTPEPSTAPSTSFLLPMGPSPP

SEQ ID NO: 3593 - protein, 34 aa, synthetic construct
  REGION 1..34: note = TNR1B Linker (17-50)
PQPVSTRSQHTQPTPEPSTAPSTSFLLPMGPSPP

SEQ ID NO: 3594 - protein, 33 aa, synthetic construct
  REGION 1..33: note = TNR1B Linker (18-50)
QPVSTRSQHTQPTPEPSTAPSTSFLLPMGPSPP

SEQ ID NO: 3595 - protein, 32 aa, synthetic construct
  REGION 1..32: note = TNR1B Linker (19-50)
PVSTRSQHTQPTPEPSTAPSTSFLLPMGPSPP

SEQ ID NO: 3596 - protein, 31 aa, synthetic construct
  REGION 1..31: note = TNR1B Linker (20-50)
VSTRSQHTQPTPEPSTAPSTSFLLPMGPSPP

SEQ ID NO: 3597 - protein, 30 aa, synthetic construct
  REGION 1..30: note = TNR1B Linker (21-50)
STRSQHTQPTPEPSTAPSTSFLLPMGPSPP

SEQ ID NO: 3598 - protein, 29 aa, synthetic construct
  REGION 1..29: note = TNR1B Linker (22-50)
TRSQHTQPTPEPSTAPSTSFLLPMGPSPP

SEQ ID NO: 3599 - protein, 28 aa, synthetic construct
  REGION 1..28: note = TNR1B Linker (23-50)
RSQHTQPTPEPSTAPSTSFLLPMGPSPP

SEQ ID NO: 3600 - protein, 27 aa, synthetic construct
  REGION 1..27: note = TNR1B Linker (24-50)
SQHTQPTPEPSTAPSTSFLLPMGPSPP

SEQ ID NO: 3601 - protein, 26 aa, synthetic construct
  REGION 1..26: note = TNR1B Linker (25-50)
QHTQPTPEPSTAPSTSFLLPMGPSPP

SEQ ID NO: 3602 - protein, 25 aa, synthetic construct
  REGION 1..25: note = TNR1B Linker (26-50)
HTQPTPEPSTAPSTSFLLPMGPSPP

SEQ ID NO: 3603 - protein, 24 aa, synthetic construct
  REGION 1..24: note = TNR1B Linker (27-50)
TQPTPEPSTAPSTSFLLPMGPSPP

SEQ ID NO: 3604 - protein, 23 aa, synthetic construct
  REGION 1..23: note = TNR1B Linker (28-50)
QPTPEPSTAPSTSFLLPMGPSPP

SEQ ID NO: 3605 - protein, 22 aa, synthetic construct
  REGION 1..22: note = TNR1B Linker (29-50)
PTPEPSTAPSTSFLLPMGPSPP

SEQ ID NO: 3606 - protein, 21 aa, synthetic construct
  REGION 1..21: note = TNR1B Linker (30-50)
TPEPSTAPSTSFLLPMGPSPP

SEQ ID NO: 3607 - protein, 20 aa, synthetic construct
  REGION 1..20: note = TNR1B Linker (31-50)
PEPSTAPSTSFLLPMGPSPP

SEQ ID NO: 3608 - protein, 19 aa, synthetic construct
  REGION 1..19: note = TNR1B Linker (32-50)
EPSTAPSTSFLLPMGPSPP

SEQ ID NO: 3609 - protein, 18 aa, synthetic construct
  REGION 1..18: note = TNR1B Linker (33-50)
PSTAPSTSFLLPMGPSPP

SEQ ID NO: 3610 - protein, 17 aa, synthetic construct
  REGION 1..17: note = TNR1B Linker (34-50)
STAPSTSFLLPMGPSPP

SEQ ID NO: 3611 - protein, 16 aa, synthetic construct
  REGION 1..16: note = TNR1B Linker (35-50)
TAPSTSFLLPMGPSPP

SEQ ID NO: 3612 - protein, 15 aa, synthetic construct
  REGION 1..15: note = TNR1B Linker (36-50)
APSTSFLLPMGPSPP

SEQ ID NO: 3613 - protein, 14 aa, synthetic construct
  REGION 1..14: note = TNR1B Linker (37-50)
PSTSFLLPMGPSPP

SEQ ID NO: 3614 - protein, 13 aa, synthetic construct
  REGION 1..13: note = TNR1B Linker (38-50)
STSFLLPMGPSPP

SEQ ID NO: 3615 - protein, 12 aa, synthetic construct
  REGION 1..12: note = TNR1B Linker (39-50)
TSFLLPMGPSPP

SEQ ID NO: 3616 - protein, 11 aa, synthetic construct
  REGION 1..11: note = TNR1B Linker (40-50)
SFLLPMGPSPP

SEQ ID NO: 3617 - protein, 10 aa, synthetic construct
  REGION 1..10: note = TNR1B Linker (41-50)
FLLPMGPSPP

SEQ ID NO: 3618 - protein, 9 aa, synthetic construct
  REGION 1..9: note = TNR1B Linker (42-50)
LLPMGPSPP

SEQ ID NO: 3619 - protein, 8 aa, synthetic construct
  REGION 1..8: note = TNR1B Linker (43-50)
LPMGPSPP

SEQ ID NO: 3620 - protein, 7 aa, synthetic construct
  REGION 1..7: note = TNR1B Linker (44-50)
PMGPSPP

SEQ ID NO: 3621 - protein, 6 aa, synthetic construct
  REGION 1..6: note = TNR1B Linker (45-50)
MGPSPP

SEQ ID NO: 3622 - protein, 5 aa, synthetic construct
  REGION 1..5: note = TNR1B Linker (46-50)
GPSPP

SEQ ID NO: 3623 - protein, 49 aa, synthetic construct
  REGION 1..49: note = TNR1B Linker (1-49)
TSTSPTRSMAPGAVHLPQPVSTRSQHTQPTPEPSTAPSTSFLLPMGPSP

SEQ ID NO: 3624 - protein, 48 aa, synthetic construct
  REGION 1..48: note = TNR1B Linker (2-49)
STSPTRSMAPGAVHLPQPVSTRSQHTQPTPEPSTAPSTSFLLPMGPSP

SEQ ID NO: 3625 - protein, 47 aa, synthetic construct
  REGION 1..47: note = TNR1B Linker (3-49)
TSPTRSMAPGAVHLPQPVSTRSQHTQPTPEPSTAPSTSFLLPMGPSP

SEQ ID NO: 3626 - protein, 46 aa, synthetic construct
  REGION 1..46: note = TNR1B Linker (4-49)
SPTRSMAPGAVHLPQPVSTRSQHTQPTPEPSTAPSTSFLLPMGPSP

SEQ ID NO: 3627 - protein, 45 aa, synthetic construct
  REGION 1..45: note = TNR1B Linker (5-49)
PTRSMAPGAVHLPQPVSTRSQHTQPTPEPSTAPSTSFLLPMGPSP

SEQ ID NO: 3628 - protein, 44 aa, synthetic construct
  REGION 1..44: note = TNR1B Linker (6-49)
TRSMAPGAVHLPQPVSTRSQHTQPTPEPSTAPSTSFLLPMGPSP

SEQ ID NO: 3629 - protein, 43 aa, synthetic construct
  REGION 1..43: note = TNR1B Linker (7-49)
RSMAPGAVHLPQPVSTRSQHTQPTPEPSTAPSTSFLLPMGPSP

SEQ ID NO: 3630 - protein, 42 aa, synthetic construct
  REGION 1..42: note = TNR1B Linker (8-49)
SMAPGAVHLPQPVSTRSQHTQPTPEPSTAPSTSFLLPMGPSP

SEQ ID NO: 3631 - protein, 41 aa, synthetic construct
  REGION 1..41: note = TNR1B Linker (9-49)
MAPGAVHLPQPVSTRSQHTQPTPEPSTAPSTSFLLPMGPSP

SEQ ID NO: 3632 - protein, 40 aa, synthetic construct
  REGION 1..40: note = TNR1B Linker (10-49)
APGAVHLPQPVSTRSQHTQPTPEPSTAPSTSFLLPMGPSP

SEQ ID NO: 3633 - protein, 39 aa, synthetic construct
  REGION 1..39: note = TNR1B Linker (11-49)
PGAVHLPQPVSTRSQHTQPTPEPSTAPSTSFLLPMGPSP

SEQ ID NO: 3634 - protein, 38 aa, synthetic construct
  REGION 1..38: note = TNR1B Linker (12-49)
GAVHLPQPVSTRSQHTQPTPEPSTAPSTSFLLPMGPSP

SEQ ID NO: 3635 - protein, 37 aa, synthetic construct
  REGION 1..37: note = TNR1B Linker (13-49)
AVHLPQPVSTRSQHTQPTPEPSTAPSTSFLLPMGPSP

SEQ ID NO: 3636 - protein, 36 aa, synthetic construct
  REGION 1..36: note = TNR1B Linker (14-49)
VHLPQPVSTRSQHTQPTPEPSTAPSTSFLLPMGPSP

SEQ ID NO: 3637 - protein, 35 aa, synthetic construct
  REGION 1..35: note = TNR1B Linker (15-49)
HLPQPVSTRSQHTQPTPEPSTAPSTSFLLPMGPSP

SEQ ID NO: 3638 - protein, 34 aa, synthetic construct
  REGION 1..34: note = TNR1B Linker (16-49)
LPQPVSTRSQHTQPTPEPSTAPSTSFLLPMGPSP

SEQ ID NO: 3639 - protein, 33 aa, synthetic construct
  REGION 1..33: note = TNR1B Linker (17-49)
PQPVSTRSQHTQPTPEPSTAPSTSFLLPMGPSP

SEQ ID NO: 3640 - protein, 32 aa, synthetic construct
  REGION 1..32: note = TNR1B Linker (18-49)
QPVSTRSQHTQPTPEPSTAPSTSFLLPMGPSP

SEQ ID NO: 3641 - protein, 31 aa, synthetic construct
  REGION 1..31: note = TNR1B Linker (19-49)
PVSTRSQHTQPTPEPSTAPSTSFLLPMGPSP

SEQ ID NO: 3642 - protein, 30 aa, synthetic construct
  REGION 1..30: note = TNR1B Linker (20-49)
VSTRSQHTQPTPEPSTAPSTSFLLPMGPSP

SEQ ID NO: 3643 - protein, 29 aa, synthetic construct
  REGION 1..29: note = TNR1B Linker (21-49)
STRSQHTQPTPEPSTAPSTSFLLPMGPSP

SEQ ID NO: 3644 - protein, 28 aa, synthetic construct
  REGION 1..28: note = TNR1B Linker (22-49)
TRSQHTQPTPEPSTAPSTSFLLPMGPSP

SEQ ID NO: 3645 - protein, 27 aa, synthetic construct
  REGION 1..27: note = TNR1B Linker (23-49)
RSQHTQPTPEPSTAPSTSFLLPMGPSP

SEQ ID NO: 3646 - protein, 26 aa, synthetic construct
  REGION 1..26: note = TNR1B Linker (24-49)
SQHTQPTPEPSTAPSTSFLLPMGPSP

SEQ ID NO: 3647 - protein, 25 aa, synthetic construct
  REGION 1..25: note = TNR1B Linker (25-49)
QHTQPTPEPSTAPSTSFLLPMGPSP

SEQ ID NO: 3648 - protein, 24 aa, synthetic construct
  REGION 1..24: note = TNR1B Linker (26-49)
HTQPTPEPSTAPSTSFLLPMGPSP

SEQ ID NO: 3649 - protein, 23 aa, synthetic construct
  REGION 1..23: note = TNR1B Linker (27-49)
TQPTPEPSTAPSTSFLLPMGPSP

SEQ ID NO: 3650 - protein, 22 aa, synthetic construct
  REGION 1..22: note = TNR1B Linker (28-49)
QPTPEPSTAPSTSFLLPMGPSP

SEQ ID NO: 3651 - protein, 21 aa, synthetic construct
  REGION 1..21: note = TNR1B Linker (29-49)
PTPEPSTAPSTSFLLPMGPSP

SEQ ID NO: 3652 - protein, 20 aa, synthetic construct
  REGION 1..20: note = TNR1B Linker (30-49)
TPEPSTAPSTSFLLPMGPSP

SEQ ID NO: 3653 - protein, 19 aa, synthetic construct
  REGION 1..19: note = TNR1B Linker (31-49)
PEPSTAPSTSFLLPMGPSP

SEQ ID NO: 3654 - protein, 18 aa, synthetic construct
  REGION 1..18: note = TNR1B Linker (32-49)
EPSTAPSTSFLLPMGPSP

SEQ ID NO: 3655 - protein, 17 aa, synthetic construct
  REGION 1..17: note = TNR1B Linker (33-49)
PSTAPSTSFLLPMGPSP

SEQ ID NO: 3656 - protein, 16 aa, synthetic construct
  REGION 1..16: note = TNR1B Linker (34-49)
STAPSTSFLLPMGPSP

SEQ ID NO: 3657 - protein, 15 aa, synthetic construct
  REGION 1..15: note = TNR1B Linker (35-49)
TAPSTSFLLPMGPSP

SEQ ID NO: 3658 - protein, 14 aa, synthetic construct
  REGION 1..14: note = TNR1B Linker (36-49)
APSTSFLLPMGPSP

SEQ ID NO: 3659 - protein, 13 aa, synthetic construct
  REGION 1..13: note = TNR1B Linker (37-49)
PSTSFLLPMGPSP

SEQ ID NO: 3660 - protein, 12 aa, synthetic construct
  REGION 1..12: note = TNR1B Linker (38-49)
STSFLLPMGPSP

SEQ ID NO: 3661 - protein, 11 aa, synthetic construct
  REGION 1..11: note = TNR1B Linker (39-49)
TSFLLPMGPSP

SEQ ID NO: 3662 - protein, 10 aa, synthetic construct
  REGION 1..10: note = TNR1B Linker (40-49)
SFLLPMGPSP

SEQ ID NO: 3663 - protein, 9 aa, synthetic construct
  REGION 1..9: note = TNR1B Linker (41-49)
FLLPMGPSP

SEQ ID NO: 3664 - protein, 8 aa, synthetic construct
  REGION 1..8: note = TNR1B Linker (42-49)
LLPMGPSP

SEQ ID NO: 3665 - protein, 7 aa, synthetic construct
  REGION 1..7: note = TNR1B Linker (43-49)
LPMGPSP

SEQ ID NO: 3666 - protein, 6 aa, synthetic construct
  REGION 1..6: note = TNR1B Linker (44-49)
PMGPSP

SEQ ID NO: 3667 - protein, 5 aa, synthetic construct
  REGION 1..5: note = TNR1B Linker (45-49)
MGPSP

SEQ ID NO: 3668 - protein, 48 aa, synthetic construct
  REGION 1..48: note = TNR1B Linker (1-48)
TSTSPTRSMAPGAVHLPQPVSTRSQHTQPTPEPSTAPSTSFLLPMGPS

SEQ ID NO: 3669 - protein, 47 aa, synthetic construct
  REGION 1..47: note = TNR1B Linker (2-48)
STSPTRSMAPGAVHLPQPVSTRSQHTQPTPEPSTAPSTSFLLPMGPS

SEQ ID NO: 3670 - protein, 46 aa, synthetic construct
  REGION 1..46: note = TNR1B Linker (3-48)
TSPTRSMAPGAVHLPQPVSTRSQHTQPTPEPSTAPSTSFLLPMGPS

SEQ ID NO: 3671 - protein, 45 aa, synthetic construct
  REGION 1..45: note = TNR1B Linker (4-48)
SPTRSMAPGAVHLPQPVSTRSQHTQPTPEPSTAPSTSFLLPMGPS

SEQ ID NO: 3672 - protein, 44 aa, synthetic construct
  REGION 1..44: note = TNR1B Linker (5-48)
PTRSMAPGAVHLPQPVSTRSQHTQPTPEPSTAPSTSFLLPMGPS

SEQ ID NO: 3673 - protein, 43 aa, synthetic construct
  REGION 1..43: note = TNR1B Linker (6-48)
TRSMAPGAVHLPQPVSTRSQHTQPTPEPSTAPSTSFLLPMGPS

SEQ ID NO: 3674 - protein, 42 aa, synthetic construct
  REGION 1..42: note = TNR1B Linker (7-48)
RSMAPGAVHLPQPVSTRSQHTQPTPEPSTAPSTSFLLPMGPS

SEQ ID NO: 3675 - protein, 41 aa, synthetic construct
  REGION 1..41: note = TNR1B Linker (8-48)
SMAPGAVHLPQPVSTRSQHTQPTPEPSTAPSTSFLLPMGPS

SEQ ID NO: 3676 - protein, 40 aa, synthetic construct
  REGION 1..40: note = TNR1B Linker (9-48)
MAPGAVHLPQPVSTRSQHTQPTPEPSTAPSTSFLLPMGPS

SEQ ID NO: 3677 - protein, 39 aa, synthetic construct
  REGION 1..39: note = TNR1B Linker (10-48)
APGAVHLPQPVSTRSQHTQPTPEPSTAPSTSFLLPMGPS

SEQ ID NO: 3678 - protein, 38 aa, synthetic construct
  REGION 1..38: note = TNR1B Linker (11-48)
PGAVHLPQPVSTRSQHTQPTPEPSTAPSTSFLLPMGPS

SEQ ID NO: 3679 - protein, 37 aa, synthetic construct
  REGION 1..37: note = TNR1B Linker (12-48)
GAVHLPQPVSTRSQHTQPTPEPSTAPSTSFLLPMGPS

SEQ ID NO: 3680 - protein, 36 aa, synthetic construct
  REGION 1..36: note = TNR1B Linker (13-48)
AVHLPQPVSTRSQHTQPTPEPSTAPSTSFLLPMGPS

SEQ ID NO: 3681 - protein, 35 aa, synthetic construct
  REGION 1..35: note = TNR1B Linker (14-48)
VHLPQPVSTRSQHTQPTPEPSTAPSTSFLLPMGPS

SEQ ID NO: 3682 - protein, 34 aa, synthetic construct
  REGION 1..34: note = TNR1B Linker (15-48)
HLPQPVSTRSQHTQPTPEPSTAPSTSFLLPMGPS

SEQ ID NO: 3683 - protein, 33 aa, synthetic construct
  REGION 1..33: note = TNR1B Linker (16-48)
LPQPVSTRSQHTQPTPEPSTAPSTSFLLPMGPS

SEQ ID NO: 3684 - protein, 32 aa, synthetic construct
  REGION 1..32: note = TNR1B Linker (17-48)
PQPVSTRSQHTQPTPEPSTAPSTSFLLPMGPS

SEQ ID NO: 3685 - protein, 31 aa, synthetic construct
  REGION 1..31: note = TNR1B Linker (18-48)
QPVSTRSQHTQPTPEPSTAPSTSFLLPMGPS

SEQ ID NO: 3686 - protein, 30 aa, synthetic construct
  REGION 1..30: note = TNR1B Linker (19-48)
PVSTRSQHTQPTPEPSTAPSTSFLLPMGPS

SEQ ID NO: 3687 - protein, 29 aa, synthetic construct
  REGION 1..29: note = TNR1B Linker (20-48)
VSTRSQHTQPTPEPSTAPSTSFLLPMGPS

SEQ ID NO: 3688 - protein, 28 aa, synthetic construct
  REGION 1..28: note = TNR1B Linker (21-48)
STRSQHTQPTPEPSTAPSTSFLLPMGPS

SEQ ID NO: 3689 - protein, 27 aa, synthetic construct
  REGION 1..27: note = TNR1B Linker (22-48)
TRSQHTQPTPEPSTAPSTSFLLPMGPS

SEQ ID NO: 3690 - protein, 26 aa, synthetic construct
  REGION 1..26: note = TNR1B Linker (23-48)
RSQHTQPTPEPSTAPSTSFLLPMGPS

SEQ ID NO: 3691 - protein, 25 aa, synthetic construct
  REGION 1..25: note = TNR1B Linker (24-48)
SQHTQPTPEPSTAPSTSFLLPMGPS

SEQ ID NO: 3692 - protein, 24 aa, synthetic construct
  REGION 1..24: note = TNR1B Linker (25-48)
QHTQPTPEPSTAPSTSFLLPMGPS

SEQ ID NO: 3693 - protein, 23 aa, synthetic construct
  REGION 1..23: note = TNR1B Linker (26-48)
HTQPTPEPSTAPSTSFLLPMGPS

SEQ ID NO: 3694 - protein, 22 aa, synthetic construct
  REGION 1..22: note = TNR1B Linker (27-48)
TQPTPEPSTAPSTSFLLPMGPS

SEQ ID NO: 3695 - protein, 21 aa, synthetic construct
  REGION 1..21: note = TNR1B Linker (28-48)
QPTPEPSTAPSTSFLLPMGPS

SEQ ID NO: 3696 - protein, 20 aa, synthetic construct
  REGION 1..20: note = TNR1B Linker (29-48)
PTPEPSTAPSTSFLLPMGPS

SEQ ID NO: 3697 - protein, 19 aa, synthetic construct
  REGION 1..19: note = TNR1B Linker (30-48)
TPEPSTAPSTSFLLPMGPS

SEQ ID NO: 3698 - protein, 18 aa, synthetic construct
  REGION 1..18: note = TNR1B Linker (31-48)
PEPSTAPSTSFLLPMGPS

SEQ ID NO: 3699 - protein, 17 aa, synthetic construct
  REGION 1..17: note = TNR1B Linker (32-48)
EPSTAPSTSFLLPMGPS

SEQ ID NO: 3700 - protein, 16 aa, synthetic construct
  REGION 1..16: note = TNR1B Linker (33-48)
PSTAPSTSFLLPMGPS

SEQ ID NO: 3701 - protein, 15 aa, synthetic construct
  REGION 1..15: note = TNR1B Linker (34-48)
STAPSTSFLLPMGPS

SEQ ID NO: 3702 - protein, 14 aa, synthetic construct
  REGION 1..14: note = TNR1B Linker (35-48)
TAPSTSFLLPMGPS

SEQ ID NO: 3703 - protein, 13 aa, synthetic construct
  REGION 1..13: note = TNR1B Linker (36-48)
APSTSFLLPMGPS

SEQ ID NO: 3704 - protein, 12 aa, synthetic construct
  REGION 1..12: note = TNR1B Linker (37-48)
PSTSFLLPMGPS

SEQ ID NO: 3705 - protein, 11 aa, synthetic construct
  REGION 1..11: note = TNR1B Linker (38-48)
STSFLLPMGPS

SEQ ID NO: 3706 - protein, 10 aa, synthetic construct
  REGION 1..10: note = TNR1B Linker (39-48)
TSFLLPMGPS

SEQ ID NO: 3707 - protein, 9 aa, synthetic construct
  REGION 1..9: note = TNR1B Linker (40-48)
SFLLPMGPS

SEQ ID NO: 3708 - protein, 8 aa, synthetic construct
  REGION 1..8: note = TNR1B Linker (41-48)
FLLPMGPS

SEQ ID NO: 3709 - protein, 7 aa, synthetic construct
  REGION 1..7: note = TNR1B Linker (42-48)
LLPMGPS

SEQ ID NO: 3710 - protein, 6 aa, synthetic construct
  REGION 1..6: note = TNR1B Linker (43-48)
LPMGPS

SEQ ID NO: 3711 - protein, 5 aa, synthetic construct
  REGION 1..5: note = TNR1B Linker (44-48)
PMGPS

SEQ ID NO: 3712 - protein, 47 aa, synthetic construct
  REGION 1..47: note = TNR1B Linker (1-47)
TSTSPTRSMAPGAVHLPQPVSTRSQHTQPTPEPSTAPSTSFLLPMGP

SEQ ID NO: 3713 - protein, 46 aa, synthetic construct
  REGION 1..46: note = TNR1B Linker (2-47)
STSPTRSMAPGAVHLPQPVSTRSQHTQPTPEPSTAPSTSFLLPMGP

SEQ ID NO: 3714 - protein, 45 aa, synthetic construct
  REGION 1..45: note = TNR1B Linker (3-47)
TSPTRSMAPGAVHLPQPVSTRSQHTQPTPEPSTAPSTSFLLPMGP

SEQ ID NO: 3715 - protein, 44 aa, synthetic construct
  REGION 1..44: note = TNR1B Linker (4-47)
SPTRSMAPGAVHLPQPVSTRSQHTQPTPEPSTAPSTSFLLPMGP

SEQ ID NO: 3716 - protein, 43 aa, synthetic construct
  REGION 1..43: note = TNR1B Linker (5-47)
PTRSMAPGAVHLPQPVSTRSQHTQPTPEPSTAPSTSFLLPMGP

SEQ ID NO: 3717 - protein, 42 aa, synthetic construct
  REGION 1..42: note = TNR1B Linker (6-47)
TRSMAPGAVHLPQPVSTRSQHTQPTPEPSTAPSTSFLLPMGP

SEQ ID NO: 3718 - protein, 41 aa, synthetic construct
  REGION 1..41: note = TNR1B Linker (7-47)
RSMAPGAVHLPQPVSTRSQHTQPTPEPSTAPSTSFLLPMGP

SEQ ID NO: 3719 - protein, 40 aa, synthetic construct
  REGION 1..40: note = TNR1B Linker (8-47)
SMAPGAVHLPQPVSTRSQHTQPTPEPSTAPSTSFLLPMGP

SEQ ID NO: 3720 - protein, 39 aa, synthetic construct
  REGION 1..39: note = TNR1B Linker (9-47)
MAPGAVHLPQPVSTRSQHTQPTPEPSTAPSTSFLLPMGP

SEQ ID NO: 3721 - protein, 38 aa, synthetic construct
  REGION 1..38: note = TNR1B Linker (10-47)
APGAVHLPQPVSTRSQHTQPTPEPSTAPSTSFLLPMGP

SEQ ID NO: 3722 - protein, 37 aa, synthetic construct
  REGION 1..37: note = TNR1B Linker (11-47)
PGAVHLPQPVSTRSQHTQPTPEPSTAPSTSFLLPMGP

SEQ ID NO: 3723 - protein, 36 aa, synthetic construct
  REGION 1..36: note = TNR1B Linker (12-47)
GAVHLPQPVSTRSQHTQPTPEPSTAPSTSFLLPMGP

SEQ ID NO: 3724 - protein, 35 aa, synthetic construct
  REGION 1..35: note = TNR1B Linker (13-47)
AVHLPQPVSTRSQHTQPTPEPSTAPSTSFLLPMGP

SEQ ID NO: 3725 - protein, 34 aa, synthetic construct
  REGION 1..34: note = TNR1B Linker (14-47)
VHLPQPVSTRSQHTQPTPEPSTAPSTSFLLPMGP

SEQ ID NO: 3726 - protein, 33 aa, synthetic construct
  REGION 1..33: note = TNR1B Linker (15-47)
HLPQPVSTRSQHTQPTPEPSTAPSTSFLLPMGP

SEQ ID NO: 3727 - protein, 32 aa, synthetic construct
  REGION 1..32: note = TNR1B Linker (16-47)
LPQPVSTRSQHTQPTPEPSTAPSTSFLLPMGP

SEQ ID NO: 3728 - protein, 31 aa, synthetic construct
  REGION 1..31: note = TNR1B Linker (17-47)
PQPVSTRSQHTQPTPEPSTAPSTSFLLPMGP

SEQ ID NO: 3729 - protein, 30 aa, synthetic construct
  REGION 1..30: note = TNR1B Linker (18-47)
QPVSTRSQHTQPTPEPSTAPSTSFLLPMGP

SEQ ID NO: 3730 - protein, 29 aa, synthetic construct
  REGION 1..29: note = TNR1B Linker (19-47)
PVSTRSQHTQPTPEPSTAPSTSFLLPMGP

SEQ ID NO: 3731 - protein, 28 aa, synthetic construct
  REGION 1..28: note = TNR1B Linker (20-47)
VSTRSQHTQPTPEPSTAPSTSFLLPMGP

SEQ ID NO: 3732 - protein, 27 aa, synthetic construct
  REGION 1..27: note = TNR1B Linker (21-47)
STRSQHTQPTPEPSTAPSTSFLLPMGP

SEQ ID NO: 3733 - protein, 26 aa, synthetic construct
  REGION 1..26: note = TNR1B Linker (22-47)
TRSQHTQPTPEPSTAPSTSFLLPMGP

SEQ ID NO: 3734 - protein, 25 aa, synthetic construct
  REGION 1..25: note = TNR1B Linker (23-47)
RSQHTQPTPEPSTAPSTSFLLPMGP

SEQ ID NO: 3735 - protein, 24 aa, synthetic construct
  REGION 1..24: note = TNR1B Linker (24-47)
SQHTQPTPEPSTAPSTSFLLPMGP

SEQ ID NO: 3736 - protein, 23 aa, synthetic construct
  REGION 1..23: note = TNR1B Linker (25-47)
QHTQPTPEPSTAPSTSFLLPMGP

SEQ ID NO: 3737 - protein, 22 aa, synthetic construct
  REGION 1..22: note = TNR1B Linker (26-47)
HTQPTPEPSTAPSTSFLLPMGP

SEQ ID NO: 3738 - protein, 21 aa, synthetic construct
  REGION 1..21: note = TNR1B Linker (27-47)
TQPTPEPSTAPSTSFLLPMGP

SEQ ID NO: 3739 - protein, 20 aa, synthetic construct
  REGION 1..20: note = TNR1B Linker (28-47)
QPTPEPSTAPSTSFLLPMGP

SEQ ID NO: 3740 - protein, 19 aa, synthetic construct
  REGION 1..19: note = TNR1B Linker (29-47)
PTPEPSTAPSTSFLLPMGP

SEQ ID NO: 3741 - protein, 18 aa, synthetic construct
  REGION 1..18: note = TNR1B Linker (30-47)
TPEPSTAPSTSFLLPMGP

SEQ ID NO: 3742 - protein, 17 aa, synthetic construct
  REGION 1..17: note = TNR1B Linker (31-47)
PEPSTAPSTSFLLPMGP

SEQ ID NO: 3743 - protein, 16 aa, synthetic construct
  REGION 1..16: note = TNR1B Linker (32-47)
EPSTAPSTSFLLPMGP

SEQ ID NO: 3744 - protein, 15 aa, synthetic construct
  REGION 1..15: note = TNR1B Linker (33-47)
PSTAPSTSFLLPMGP

SEQ ID NO: 3745 - protein, 14 aa, synthetic construct
  REGION 1..14: note = TNR1B Linker (34-47)
STAPSTSFLLPMGP

SEQ ID NO: 3746 - protein, 13 aa, synthetic construct
  REGION 1..13: note = TNR1B Linker (35-47)
TAPSTSFLLPMGP

SEQ ID NO: 3747 - protein, 12 aa, synthetic construct
  REGION 1..12: note = TNR1B Linker (36-47)
APSTSFLLPMGP

SEQ ID NO: 3748 - protein, 11 aa, synthetic construct
  REGION 1..11: note = TNR1B Linker (37-47)
PSTSFLLPMGP

SEQ ID NO: 3749 - protein, 10 aa, synthetic construct
  REGION 1..10: note = TNR1B Linker (38-47)
STSFLLPMGP

SEQ ID NO: 3750 - protein, 9 aa, synthetic construct
  REGION 1..9: note = TNR1B Linker (39-47)
TSFLLPMGP

SEQ ID NO: 3751 - protein, 8 aa, synthetic construct
  REGION 1..8: note = TNR1B Linker (40-47)
SFLLPMGP

SEQ ID NO: 3752 - protein, 7 aa, synthetic construct
  REGION 1..7: note = TNR1B Linker (41-47)
FLLPMGP

SEQ ID NO: 3753 - protein, 6 aa, synthetic construct
  REGION 1..6: note = TNR1B Linker (42-47)
LLPMGP

SEQ ID NO: 3754 - protein, 5 aa, synthetic construct
  REGION 1..5: note = TNR1B Linker (43-47)
LPMGP

SEQ ID NO: 3755 - protein, 46 aa, synthetic construct
  REGION 1..46: note = TNR1B Linker (1-46)
TSTSPTRSMAPGAVHLPQPVSTRSQHTQPTPEPSTAPSTSFLLPMG

SEQ ID NO: 3756 - protein, 45 aa, synthetic construct
  REGION 1..45: note = TNR1B Linker (2-46)
STSPTRSMAPGAVHLPQPVSTRSQHTQPTPEPSTAPSTSFLLPMG

SEQ ID NO: 3757 - protein, 44 aa, synthetic construct
  REGION 1..44: note = TNR1B Linker (3-46)
TSPTRSMAPGAVHLPQPVSTRSQHTQPTPEPSTAPSTSFLLPMG

SEQ ID NO: 3758 - protein, 43 aa, synthetic construct
  REGION 1..43: note = TNR1B Linker (4-46)
SPTRSMAPGAVHLPQPVSTRSQHTQPTPEPSTAPSTSFLLPMG

SEQ ID NO: 3759 - protein, 42 aa, synthetic construct
  REGION 1..42: note = TNR1B Linker (5-46)
PTRSMAPGAVHLPQPVSTRSQHTQPTPEPSTAPSTSFLLPMG

SEQ ID NO: 3760 - protein, 41 aa, synthetic construct
  REGION 1..41: note = TNR1B Linker (6-46)
TRSMAPGAVHLPQPVSTRSQHTQPTPEPSTAPSTSFLLPMG

SEQ ID NO: 3761 - protein, 40 aa, synthetic construct
  REGION 1..40: note = TNR1B Linker (7-46)
RSMAPGAVHLPQPVSTRSQHTQPTPEPSTAPSTSFLLPMG

SEQ ID NO: 3762 - protein, 39 aa, synthetic construct
  REGION 1..39: note = TNR1B Linker (8-46)
SMAPGAVHLPQPVSTRSQHTQPTPEPSTAPSTSFLLPMG

SEQ ID NO: 3763 - protein, 38 aa, synthetic construct
  REGION 1..38: note = TNR1B Linker (9-46)
MAPGAVHLPQPVSTRSQHTQPTPEPSTAPSTSFLLPMG

SEQ ID NO: 3764 - protein, 37 aa, synthetic construct
  REGION 1..37: note = TNR1B Linker (10-46)
APGAVHLPQPVSTRSQHTQPTPEPSTAPSTSFLLPMG

SEQ ID NO: 3765 - protein, 36 aa, synthetic construct
  REGION 1..36: note = TNR1B Linker (11-46)
PGAVHLPQPVSTRSQHTQPTPEPSTAPSTSFLLPMG

SEQ ID NO: 3766 - protein, 35 aa, synthetic construct
  REGION 1..35: note = TNR1B Linker (12-46)
GAVHLPQPVSTRSQHTQPTPEPSTAPSTSFLLPMG

SEQ ID NO: 3767 - protein, 34 aa, synthetic construct
  REGION 1..34: note = TNR1B Linker (13-46)
AVHLPQPVSTRSQHTQPTPEPSTAPSTSFLLPMG

SEQ ID NO: 3768 - protein, 33 aa, synthetic construct
  REGION 1..33: note = TNR1B Linker (14-46)
VHLPQPVSTRSQHTQPTPEPSTAPSTSFLLPMG

SEQ ID NO: 3769 - protein, 32 aa, synthetic construct
  REGION 1..32: note = TNR1B Linker (15-46)
HLPQPVSTRSQHTQPTPEPSTAPSTSFLLPMG

SEQ ID NO: 3770 - protein, 31 aa, synthetic construct
  REGION 1..31: note = TNR1B Linker (16-46)
LPQPVSTRSQHTQPTPEPSTAPSTSFLLPMG

SEQ ID NO: 3771 - protein, 30 aa, synthetic construct
  REGION 1..30: note = TNR1B Linker (17-46)
PQPVSTRSQHTQPTPEPSTAPSTSFLLPMG

SEQ ID NO: 3772 - protein, 29 aa, synthetic construct
  REGION 1..29: note = TNR1B Linker (18-46)
QPVSTRSQHTQPTPEPSTAPSTSFLLPMG

SEQ ID NO: 3773 - protein, 28 aa, synthetic construct
  REGION 1..28: note = TNR1B Linker (19-46)
PVSTRSQHTQPTPEPSTAPSTSFLLPMG

SEQ ID NO: 3774 - protein, 27 aa, synthetic construct
  REGION 1..27: note = TNR1B Linker (20-46)
VSTRSQHTQPTPEPSTAPSTSFLLPMG

SEQ ID NO: 3775 - protein, 26 aa, synthetic construct
  REGION 1..26: note = TNR1B Linker (21-46)
STRSQHTQPTPEPSTAPSTSFLLPMG

SEQ ID NO: 3776 - protein, 25 aa, synthetic construct
  REGION 1..25: note = TNR1B Linker (22-46)
TRSQHTQPTPEPSTAPSTSFLLPMG

SEQ ID NO: 3777 - protein, 24 aa, synthetic construct
  REGION 1..24: note = TNR1B Linker (23-46)
RSQHTQPTPEPSTAPSTSFLLPMG

SEQ ID NO: 3778 - protein, 23 aa, synthetic construct
  REGION 1..23: note = TNR1B Linker (24-46)
SQHTQPTPEPSTAPSTSFLLPMG

SEQ ID NO: 3779 - protein, 22 aa, synthetic construct
  REGION 1..22: note = TNR1B Linker (25-46)
QHTQPTPEPSTAPSTSFLLPMG

SEQ ID NO: 3780 - protein, 21 aa, synthetic construct
  REGION 1..21: note = TNR1B Linker (26-46)
HTQPTPEPSTAPSTSFLLPMG

SEQ ID NO: 3781 - protein, 20 aa, synthetic construct
  REGION 1..20: note = TNR1B Linker (27-46)
TQPTPEPSTAPSTSFLLPMG

SEQ ID NO: 3782 - protein, 19 aa, synthetic construct
  REGION 1..19: note = TNR1B Linker (28-46)
QPTPEPSTAPSTSFLLPMG

SEQ ID NO: 3783 - protein, 18 aa, synthetic construct
  REGION 1..18: note = TNR1B Linker (29-46)
PTPEPSTAPSTSFLLPMG

SEQ ID NO: 3784 - protein, 17 aa, synthetic construct
  REGION 1..17: note = TNR1B Linker (30-46)
TPEPSTAPSTSFLLPMG

SEQ ID NO: 3785 - protein, 16 aa, synthetic construct
  REGION 1..16: note = TNR1B Linker (31-46)
PEPSTAPSTSFLLPMG

SEQ ID NO: 3786 - protein, 15 aa, synthetic construct
  REGION 1..15: note = TNR1B Linker (32-46)
EPSTAPSTSFLLPMG

SEQ ID NO: 3787 - protein, 14 aa, synthetic construct
  REGION 1..14: note = TNR1B Linker (33-46)
PSTAPSTSFLLPMG

SEQ ID NO: 3788 - protein, 13 aa, synthetic construct
  REGION 1..13: note = TNR1B Linker (34-46)
STAPSTSFLLPMG

SEQ ID NO: 3789 - protein, 12 aa, synthetic construct
  REGION 1..12: note = TNR1B Linker (35-46)
TAPSTSFLLPMG

SEQ ID NO: 3790 - protein, 11 aa, synthetic construct
  REGION 1..11: note = TNR1B Linker (36-46)
APSTSFLLPMG

SEQ ID NO: 3791 - protein, 10 aa, synthetic construct
  REGION 1..10: note = TNR1B Linker (37-46)
PSTSFLLPMG

SEQ ID NO: 3792 - protein, 9 aa, synthetic construct
  REGION 1..9: note = TNR1B Linker (38-46)
STSFLLPMG

SEQ ID NO: 3793 - protein, 8 aa, synthetic construct
  REGION 1..8: note = TNR1B Linker (39-46)
TSFLLPMG

SEQ ID NO: 3794 - protein, 7 aa, synthetic construct
  REGION 1..7: note = TNR1B Linker (40-46)
SFLLPMG

SEQ ID NO: 3795 - protein, 6 aa, synthetic construct
  REGION 1..6: note = TNR1B Linker (41-46)
FLLPMG

SEQ ID NO: 3796 - protein, 5 aa, synthetic construct
  REGION 1..5: note = TNR1B Linker (42-46)
LLPMG

SEQ ID NO: 3797 - protein, 45 aa, synthetic construct
  REGION 1..45: note = TNR1B Linker (1-45)
TSTSPTRSMAPGAVHLPQPVSTRSQHTQPTPEPSTAPSTSFLLPM

SEQ ID NO: 3798 - protein, 44 aa, synthetic construct
  REGION 1..44: note = TNR1B Linker (2-45)
STSPTRSMAPGAVHLPQPVSTRSQHTQPTPEPSTAPSTSFLLPM

SEQ ID NO: 3799 - protein, 43 aa, synthetic construct
  REGION 1..43: note = TNR1B Linker (3-45)
TSPTRSMAPGAVHLPQPVSTRSQHTQPTPEPSTAPSTSFLLPM

SEQ ID NO: 3800 - protein, 42 aa, synthetic construct
  REGION 1..42: note = TNR1B Linker (4-45)
SPTRSMAPGAVHLPQPVSTRSQHTQPTPEPSTAPSTSFLLPM

SEQ ID NO: 3801 - protein, 41 aa, synthetic construct
  REGION 1..41: note = TNR1B Linker (5-45)
PTRSMAPGAVHLPQPVSTRSQHTQPTPEPSTAPSTSFLLPM

SEQ ID NO: 3802 - protein, 40 aa, synthetic construct
  REGION 1..40: note = TNR1B Linker (6-45)
TRSMAPGAVHLPQPVSTRSQHTQPTPEPSTAPSTSFLLPM

SEQ ID NO: 3803 - protein, 39 aa, synthetic construct
  REGION 1..39: note = TNR1B Linker (7-45)
RSMAPGAVHLPQPVSTRSQHTQPTPEPSTAPSTSFLLPM

SEQ ID NO: 3804 - protein, 38 aa, synthetic construct
  REGION 1..38: note = TNR1B Linker (8-45)
SMAPGAVHLPQPVSTRSQHTQPTPEPSTAPSTSFLLPM

SEQ ID NO: 3805 - protein, 37 aa, synthetic construct
  REGION 1..37: note = TNR1B Linker (9-45)
MAPGAVHLPQPVSTRSQHTQPTPEPSTAPSTSFLLPM

SEQ ID NO: 3806 - protein, 36 aa, synthetic construct
  REGION 1..36: note = TNR1B Linker (10-45)
APGAVHLPQPVSTRSQHTQPTPEPSTAPSTSFLLPM

SEQ ID NO: 3807 - protein, 35 aa, synthetic construct
  REGION 1..35: note = TNR1B Linker (11-45)
PGAVHLPQPVSTRSQHTQPTPEPSTAPSTSFLLPM

SEQ ID NO: 3808 - protein, 34 aa, synthetic construct
  REGION 1..34: note = TNR1B Linker (12-45)
GAVHLPQPVSTRSQHTQPTPEPSTAPSTSFLLPM

SEQ ID NO: 3809 - protein, 33 aa, synthetic construct
  REGION 1..33: note = TNR1B Linker (13-45)
AVHLPQPVSTRSQHTQPTPEPSTAPSTSFLLPM

SEQ ID NO: 3810 - protein, 32 aa, synthetic construct
  REGION 1..32: note = TNR1B Linker (14-45)
VHLPQPVSTRSQHTQPTPEPSTAPSTSFLLPM

SEQ ID NO: 3811 - protein, 31 aa, synthetic construct
  REGION 1..31: note = TNR1B Linker (15-45)
HLPQPVSTRSQHTQPTPEPSTAPSTSFLLPM

SEQ ID NO: 3812 - protein, 30 aa, synthetic construct
  REGION 1..30: note = TNR1B Linker (16-45)
LPQPVSTRSQHTQPTPEPSTAPSTSFLLPM

SEQ ID NO: 3813 - protein, 29 aa, synthetic construct
  REGION 1..29: note = TNR1B Linker (17-45)
PQPVSTRSQHTQPTPEPSTAPSTSFLLPM

SEQ ID NO: 3814 - protein, 28 aa, synthetic construct
  REGION 1..28: note = TNR1B Linker (18-45)
QPVSTRSQHTQPTPEPSTAPSTSFLLPM

SEQ ID NO: 3815 - protein, 27 aa, synthetic construct
  REGION 1..27: note = TNR1B Linker (19-45)
PVSTRSQHTQPTPEPSTAPSTSFLLPM

SEQ ID NO: 3816 - protein, 26 aa, synthetic construct
  REGION 1..26: note = TNR1B Linker (20-45)
VSTRSQHTQPTPEPSTAPSTSFLLPM

SEQ ID NO: 3817 - protein, 25 aa, synthetic construct
  REGION 1..25: note = TNR1B Linker (21-45)
STRSQHTQPTPEPSTAPSTSFLLPM

SEQ ID NO: 3818 - protein, 24 aa, synthetic construct
  REGION 1..24: note = TNR1B Linker (22-45)
TRSQHTQPTPEPSTAPSTSFLLPM

SEQ ID NO: 3819 - protein, 23 aa, synthetic construct
  REGION 1..23: note = TNR1B Linker (23-45)
RSQHTQPTPEPSTAPSTSFLLPM

SEQ ID NO: 3820 - protein, 22 aa, synthetic construct
  REGION 1..22: note = TNR1B Linker (24-45)
SQHTQPTPEPSTAPSTSFLLPM

SEQ ID NO: 3821 - protein, 21 aa, synthetic construct
  REGION 1..21: note = TNR1B Linker (25-45)
QHTQPTPEPSTAPSTSFLLPM

SEQ ID NO: 3822 - protein, 20 aa, synthetic construct
  REGION 1..20: note = TNR1B Linker (26-45)
HTQPTPEPSTAPSTSFLLPM

SEQ ID NO: 3823 - protein, 19 aa, synthetic construct
  REGION 1..19: note = TNR1B Linker (27-45)
TQPTPEPSTAPSTSFLLPM

SEQ ID NO: 3824 - protein, 18 aa, synthetic construct
  REGION 1..18: note = TNR1B Linker (28-45)
QPTPEPSTAPSTSFLLPM

SEQ ID NO: 3825 - protein, 17 aa, synthetic construct
  REGION 1..17: note = TNR1B Linker (29-45)
PTPEPSTAPSTSFLLPM

SEQ ID NO: 3826 - protein, 16 aa, synthetic construct
  REGION 1..16: note = TNR1B Linker (30-45)
TPEPSTAPSTSFLLPM

SEQ ID NO: 3827 - protein, 15 aa, synthetic construct
  REGION 1..15: note = TNR1B Linker (31-45)
PEPSTAPSTSFLLPM

SEQ ID NO: 3828 - protein, 14 aa, synthetic construct
  REGION 1..14: note = TNR1B Linker (32-45)
EPSTAPSTSFLLPM

SEQ ID NO: 3829 - protein, 13 aa, synthetic construct
  REGION 1..13: note = TNR1B Linker (33-45)
PSTAPSTSFLLPM

SEQ ID NO: 3830 - protein, 12 aa, synthetic construct
  REGION 1..12: note = TNR1B Linker (34-45)
STAPSTSFLLPM

SEQ ID NO: 3831 - protein, 11 aa, synthetic construct
  REGION 1..11: note = TNR1B Linker (35-45)
TAPSTSFLLPM

SEQ ID NO: 3832 - protein, 10 aa, synthetic construct
  REGION 1..10: note = TNR1B Linker (36-45)
APSTSFLLPM

SEQ ID NO: 3833 - protein, 9 aa, synthetic construct
  REGION 1..9: note = TNR1B Linker (37-45)
PSTSFLLPM

SEQ ID NO: 3834 - protein, 8 aa, synthetic construct
  REGION 1..8: note = TNR1B Linker (38-45)
STSFLLPM

SEQ ID NO: 3835 - protein, 7 aa, synthetic construct
  REGION 1..7: note = TNR1B Linker (39-45)
TSFLLPM

SEQ ID NO: 3836 - protein, 6 aa, synthetic construct
  REGION 1..6: note = TNR1B Linker (40-45)
SFLLPM

SEQ ID NO: 3837 - protein, 5 aa, synthetic construct
  REGION 1..5: note = TNR1B Linker (41-45)
FLLPM

SEQ ID NO: 3838 - protein, 44 aa, synthetic construct
  REGION 1..44: note = TNR1B Linker (1-44)
TSTSPTRSMAPGAVHLPQPVSTRSQHTQPTPEPSTAPSTSFLLP

SEQ ID NO: 3839 - protein, 43 aa, synthetic construct
  REGION 1..43: note = TNR1B Linker (2-44)
STSPTRSMAPGAVHLPQPVSTRSQHTQPTPEPSTAPSTSFLLP

SEQ ID NO: 3840 - protein, 42 aa, synthetic construct
  REGION 1..42: note = TNR1B Linker (3-44)
TSPTRSMAPGAVHLPQPVSTRSQHTQPTPEPSTAPSTSFLLP

SEQ ID NO: 3841 - protein, 41 aa, synthetic construct
  REGION 1..41: note = TNR1B Linker (4-44)
SPTRSMAPGAVHLPQPVSTRSQHTQPTPEPSTAPSTSFLLP

SEQ ID NO: 3842 - protein, 40 aa, synthetic construct
  REGION 1..40: note = TNR1B Linker (5-44)
PTRSMAPGAVHLPQPVSTRSQHTQPTPEPSTAPSTSFLLP

SEQ ID NO: 3843 - protein, 39 aa, synthetic construct
  REGION 1..39: note = TNR1B Linker (6-44)
TRSMAPGAVHLPQPVSTRSQHTQPTPEPSTAPSTSFLLP

SEQ ID NO: 3844 - protein, 38 aa, synthetic construct
  REGION 1..38: note = TNR1B Linker (7-44)
RSMAPGAVHLPQPVSTRSQHTQPTPEPSTAPSTSFLLP

SEQ ID NO: 3845 - protein, 37 aa, synthetic construct
  REGION 1..37: note = TNR1B Linker (8-44)
SMAPGAVHLPQPVSTRSQHTQPTPEPSTAPSTSFLLP

SEQ ID NO: 3846 - protein, 36 aa, synthetic construct
  REGION 1..36: note = TNR1B Linker (9-44)
MAPGAVHLPQPVSTRSQHTQPTPEPSTAPSTSFLLP

SEQ ID NO: 3847 - protein, 35 aa, synthetic construct
  REGION 1..35: note = TNR1B Linker (10-44)
APGAVHLPQPVSTRSQHTQPTPEPSTAPSTSFLLP

SEQ ID NO: 3848 - protein, 34 aa, synthetic construct
  REGION 1..34: note = TNR1B Linker (11-44)
PGAVHLPQPVSTRSQHTQPTPEPSTAPSTSFLLP

SEQ ID NO: 3849 - protein, 33 aa, synthetic construct
  REGION 1..33: note = TNR1B Linker (12-44)
GAVHLPQPVSTRSQHTQPTPEPSTAPSTSFLLP

SEQ ID NO: 3850 - protein, 32 aa, synthetic construct
  REGION 1..32: note = TNR1B Linker (13-44)
AVHLPQPVSTRSQHTQPTPEPSTAPSTSFLLP

SEQ ID NO: 3851 - protein, 31 aa, synthetic construct
  REGION 1..31: note = TNR1B Linker (14-44)
VHLPQPVSTRSQHTQPTPEPSTAPSTSFLLP

SEQ ID NO: 3852 - protein, 30 aa, synthetic construct
  REGION 1..30: note = TNR1B Linker (15-44)
HLPQPVSTRSQHTQPTPEPSTAPSTSFLLP

SEQ ID NO: 3853 - protein, 29 aa, synthetic construct
  REGION 1..29: note = TNR1B Linker (16-44)
LPQPVSTRSQHTQPTPEPSTAPSTSFLLP

SEQ ID NO: 3854 - protein, 28 aa, synthetic construct
  REGION 1..28: note = TNR1B Linker (17-44)
PQPVSTRSQHTQPTPEPSTAPSTSFLLP

SEQ ID NO: 3855 - protein, 27 aa, synthetic construct
  REGION 1..27: note = TNR1B Linker (18-44)
QPVSTRSQHTQPTPEPSTAPSTSFLLP

SEQ ID NO: 3856 - protein, 26 aa, synthetic construct
  REGION 1..26: note = TNR1B Linker (19-44)
PVSTRSQHTQPTPEPSTAPSTSFLLP

SEQ ID NO: 3857 - protein, 25 aa, synthetic construct
  REGION 1..25: note = TNR1B Linker (20-44)
VSTRSQHTQPTPEPSTAPSTSFLLP

SEQ ID NO: 3858 - protein, 24 aa, synthetic construct
  REGION 1..24: note = TNR1B Linker (21-44)
STRSQHTQPTPEPSTAPSTSFLLP

SEQ ID NO: 3859 - protein, 23 aa, synthetic construct
  REGION 1..23: note = TNR1B Linker (22-44)
TRSQHTQPTPEPSTAPSTSFLLP

SEQ ID NO: 3860 - protein, 22 aa, synthetic construct
  REGION 1..22: note = TNR1B Linker (23-44)
RSQHTQPTPEPSTAPSTSFLLP

SEQ ID NO: 3861 - protein, 21 aa, synthetic construct
  REGION 1..21: note = TNR1B Linker (24-44)
SQHTQPTPEPSTAPSTSFLLP

SEQ ID NO: 3862 - protein, 20 aa, synthetic construct
  REGION 1..20: note = TNR1B Linker (25-44)
QHTQPTPEPSTAPSTSFLLP

SEQ ID NO: 3863 - protein, 19 aa, synthetic construct
  REGION 1..19: note = TNR1B Linker (26-44)
HTQPTPEPSTAPSTSFLLP

SEQ ID NO: 3864 - protein, 18 aa, synthetic construct
  REGION 1..18: note = TNR1B Linker (27-44)
TQPTPEPSTAPSTSFLLP

SEQ ID NO: 3865 - protein, 17 aa, synthetic construct
  REGION 1..17: note = TNR1B Linker (28-44)
QPTPEPSTAPSTSFLLP

SEQ ID NO: 3866 - protein, 16 aa, synthetic construct
  REGION 1..16: note = TNR1B Linker (29-44)
PTPEPSTAPSTSFLLP

SEQ ID NO: 3867 - protein, 15 aa, synthetic construct
  REGION 1..15: note = TNR1B Linker (30-44)
TPEPSTAPSTSFLLP

SEQ ID NO: 3868 - protein, 14 aa, synthetic construct
  REGION 1..14: note = TNR1B Linker (31-44)
PEPSTAPSTSFLLP

SEQ ID NO: 3869 - protein, 13 aa, synthetic construct
  REGION 1..13: note = TNR1B Linker (32-44)
EPSTAPSTSFLLP

SEQ ID NO: 3870 - protein, 12 aa, synthetic construct
  REGION 1..12: note = TNR1B Linker (33-44)
PSTAPSTSFLLP

SEQ ID NO: 3871 - protein, 11 aa, synthetic construct
  REGION 1..11: note = TNR1B Linker (34-44)
STAPSTSFLLP

SEQ ID NO: 3872 - protein, 10 aa, synthetic construct
  REGION 1..10: note = TNR1B Linker (35-44)
TAPSTSFLLP

SEQ ID NO: 3873 - protein, 9 aa, synthetic construct
  REGION 1..9: note = TNR1B Linker (36-44)
APSTSFLLP

SEQ ID NO: 3874 - protein, 8 aa, synthetic construct
  REGION 1..8: note = TNR1B Linker (37-44)
PSTSFLLP

SEQ ID NO: 3875 - protein, 7 aa, synthetic construct
  REGION 1..7: note = TNR1B Linker (38-44)
STSFLLP

SEQ ID NO: 3876 - protein, 6 aa, synthetic construct
  REGION 1..6: note = TNR1B Linker (39-44)
TSFLLP

SEQ ID NO: 3877 - protein, 5 aa, synthetic construct
  REGION 1..5: note = TNR1B Linker (40-44)
SFLLP

SEQ ID NO: 3878 - protein, 43 aa, synthetic construct
  REGION 1..43: note = TNR1B Linker (1-43)
TSTSPTRSMAPGAVHLPQPVSTRSQHTQPTPEPSTAPSTSFLL

SEQ ID NO: 3879 - protein, 42 aa, synthetic construct
  REGION 1..42: note = TNR1B Linker (2-43)
STSPTRSMAPGAVHLPQPVSTRSQHTQPTPEPSTAPSTSFLL

SEQ ID NO: 3880 - protein, 41 aa, synthetic construct
  REGION 1..41: note = TNR1B Linker (3-43)
TSPTRSMAPGAVHLPQPVSTRSQHTQPTPEPSTAPSTSFLL

SEQ ID NO: 3881 - protein, 40 aa, synthetic construct
  REGION 1..40: note = TNR1B Linker (4-43)
SPTRSMAPGAVHLPQPVSTRSQHTQPTPEPSTAPSTSFLL

SEQ ID NO: 3882 - protein, 39 aa, synthetic construct
  REGION 1..39: note = TNR1B Linker (5-43)
PTRSMAPGAVHLPQPVSTRSQHTQPTPEPSTAPSTSFLL

SEQ ID NO: 3883 - protein, 38 aa, synthetic construct
  REGION 1..38: note = TNR1B Linker (6-43)
TRSMAPGAVHLPQPVSTRSQHTQPTPEPSTAPSTSFLL

SEQ ID NO: 3884 - protein, 37 aa, synthetic construct
  REGION 1..37: note = TNR1B Linker (7-43)
RSMAPGAVHLPQPVSTRSQHTQPTPEPSTAPSTSFLL

SEQ ID NO: 3885 - protein, 36 aa, synthetic construct
  REGION 1..36: note = TNR1B Linker (8-43)
SMAPGAVHLPQPVSTRSQHTQPTPEPSTAPSTSFLL

SEQ ID NO: 3886 - protein, 35 aa, synthetic construct
  REGION 1..35: note = TNR1B Linker (9-43)
MAPGAVHLPQPVSTRSQHTQPTPEPSTAPSTSFLL

SEQ ID NO: 3887 - protein, 34 aa, synthetic construct
  REGION 1..34: note = TNR1B Linker (10-43)
APGAVHLPQPVSTRSQHTQPTPEPSTAPSTSFLL

SEQ ID NO: 3888 - protein, 33 aa, synthetic construct
  REGION 1..33: note = TNR1B Linker (11-43)
PGAVHLPQPVSTRSQHTQPTPEPSTAPSTSFLL

SEQ ID NO: 3889 - protein, 32 aa, synthetic construct
  REGION 1..32: note = TNR1B Linker (12-43)
GAVHLPQPVSTRSQHTQPTPEPSTAPSTSFLL

SEQ ID NO: 3890 - protein, 31 aa, synthetic construct
  REGION 1..31: note = TNR1B Linker (13-43)
AVHLPQPVSTRSQHTQPTPEPSTAPSTSFLL

SEQ ID NO: 3891 - protein, 30 aa, synthetic construct
  REGION 1..30: note = TNR1B Linker (14-43)
VHLPQPVSTRSQHTQPTPEPSTAPSTSFLL

SEQ ID NO: 3892 - protein, 29 aa, synthetic construct
  REGION 1..29: note = TNR1B Linker (15-43)
HLPQPVSTRSQHTQPTPEPSTAPSTSFLL

SEQ ID NO: 3893 - protein, 28 aa, synthetic construct
  REGION 1..28: note = TNR1B Linker (16-43)
LPQPVSTRSQHTQPTPEPSTAPSTSFLL

SEQ ID NO: 3894 - protein, 27 aa, synthetic construct
  REGION 1..27: note = TNR1B Linker (17-43)
PQPVSTRSQHTQPTPEPSTAPSTSFLL

SEQ ID NO: 3895 - protein, 26 aa, synthetic construct
  REGION 1..26: note = TNR1B Linker (18-43)
QPVSTRSQHTQPTPEPSTAPSTSFLL

SEQ ID NO: 3896 - protein, 25 aa, synthetic construct
  REGION 1..25: note = TNR1B Linker (19-43)
PVSTRSQHTQPTPEPSTAPSTSFLL

SEQ ID NO: 3897 - protein, 24 aa, synthetic construct
  REGION 1..24: note = TNR1B Linker (20-43)
VSTRSQHTQPTPEPSTAPSTSFLL

SEQ ID NO: 3898 - protein, 23 aa, synthetic construct
  REGION 1..23: note = TNR1B Linker (21-43)
STRSQHTQPTPEPSTAPSTSFLL

SEQ ID NO: 3899 - protein, 22 aa, synthetic construct
  REGION 1..22: note = TNR1B Linker (22-43)
TRSQHTQPTPEPSTAPSTSFLL

SEQ ID NO: 3900 - protein, 21 aa, synthetic construct
  REGION 1..21: note = TNR1B Linker (23-43)
RSQHTQPTPEPSTAPSTSFLL

SEQ ID NO: 3901 - protein, 20 aa, synthetic construct
  REGION 1..20: note = TNR1B Linker (24-43)
SQHTQPTPEPSTAPSTSFLL

SEQ ID NO: 3902 - protein, 19 aa, synthetic construct
  REGION 1..19: note = TNR1B Linker (25-43)
QHTQPTPEPSTAPSTSFLL

SEQ ID NO: 3903 - protein, 18 aa, synthetic construct
  REGION 1..18: note = TNR1B Linker (26-43)
HTQPTPEPSTAPSTSFLL

SEQ ID NO: 3904 - protein, 17 aa, synthetic construct
  REGION 1..17: note = TNR1B Linker (27-43)
TQPTPEPSTAPSTSFLL

SEQ ID NO: 3905 - protein, 16 aa, synthetic construct
  REGION 1..16: note = TNR1B Linker (28-43)
QPTPEPSTAPSTSFLL

SEQ ID NO: 3906 - protein, 15 aa, synthetic construct
  REGION 1..15: note = TNR1B Linker (29-43)
PTPEPSTAPSTSFLL

SEQ ID NO: 3907 - protein, 14 aa, synthetic construct
  REGION 1..14: note = TNR1B Linker (30-43)
TPEPSTAPSTSFLL

SEQ ID NO: 3908 - protein, 13 aa, synthetic construct
  REGION 1..13: note = TNR1B Linker (31-43)
PEPSTAPSTSFLL

SEQ ID NO: 3909 - protein, 12 aa, synthetic construct
  REGION 1..12: note = TNR1B Linker (32-43)
EPSTAPSTSFLL

SEQ ID NO: 3910 - protein, 11 aa, synthetic construct
  REGION 1..11: note = TNR1B Linker (33-43)
PSTAPSTSFLL

SEQ ID NO: 3911 - protein, 10 aa, synthetic construct
  REGION 1..10: note = TNR1B Linker (34-43)
STAPSTSFLL

SEQ ID NO: 3912 - protein, 9 aa, synthetic construct
  REGION 1..9: note = TNR1B Linker (35-43)
TAPSTSFLL

SEQ ID NO: 3913 - protein, 8 aa, synthetic construct
  REGION 1..8: note = TNR1B Linker (36-43)
APSTSFLL

SEQ ID NO: 3914 - protein, 7 aa, synthetic construct
  REGION 1..7: note = TNR1B Linker (37-43)
PSTSFLL

SEQ ID NO: 3915 - protein, 6 aa, synthetic construct
  REGION 1..6: note = TNR1B Linker (38-43)
STSFLL

SEQ ID NO: 3916 - protein, 5 aa, synthetic construct
  REGION 1..5: note = TNR1B Linker (39-43)
TSFLL

SEQ ID NO: 3917 - protein, 42 aa, synthetic construct
  REGION 1..42: note = TNR1B Linker (1-42)
TSTSPTRSMAPGAVHLPQPVSTRSQHTQPTPEPSTAPSTSFL

SEQ ID NO: 3918 - protein, 41 aa, synthetic construct
  REGION 1..41: note = TNR1B Linker (2-42)
STSPTRSMAPGAVHLPQPVSTRSQHTQPTPEPSTAPSTSFL

SEQ ID NO: 3919 - protein, 40 aa, synthetic construct
  REGION 1..40: note = TNR1B Linker (3-42)
TSPTRSMAPGAVHLPQPVSTRSQHTQPTPEPSTAPSTSFL

SEQ ID NO: 3920 - protein, 39 aa, synthetic construct
  REGION 1..39: note = TNR1B Linker (4-42)
SPTRSMAPGAVHLPQPVSTRSQHTQPTPEPSTAPSTSFL

SEQ ID NO: 3921 - protein, 38 aa, synthetic construct
  REGION 1..38: note = TNR1B Linker (5-42)
PTRSMAPGAVHLPQPVSTRSQHTQPTPEPSTAPSTSFL

SEQ ID NO: 3922 - protein, 37 aa, synthetic construct
  REGION 1..37: note = TNR1B Linker (6-42)
TRSMAPGAVHLPQPVSTRSQHTQPTPEPSTAPSTSFL

SEQ ID NO: 3923 - protein, 36 aa, synthetic construct
  REGION 1..36: note = TNR1B Linker (7-42)
RSMAPGAVHLPQPVSTRSQHTQPTPEPSTAPSTSFL

SEQ ID NO: 3924 - protein, 35 aa, synthetic construct
  REGION 1..35: note = TNR1B Linker (8-42)
SMAPGAVHLPQPVSTRSQHTQPTPEPSTAPSTSFL

SEQ ID NO: 3925 - protein, 34 aa, synthetic construct
  REGION 1..34: note = TNR1B Linker (9-42)
MAPGAVHLPQPVSTRSQHTQPTPEPSTAPSTSFL

SEQ ID NO: 3926 - protein, 33 aa, synthetic construct
  REGION 1..33: note = TNR1B Linker (10-42)
APGAVHLPQPVSTRSQHTQPTPEPSTAPSTSFL

SEQ ID NO: 3927 - protein, 32 aa, synthetic construct
  REGION 1..32: note = TNR1B Linker (11-42)
PGAVHLPQPVSTRSQHTQPTPEPSTAPSTSFL

SEQ ID NO: 3928 - protein, 31 aa, synthetic construct
  REGION 1..31: note = TNR1B Linker (12-42)
GAVHLPQPVSTRSQHTQPTPEPSTAPSTSFL

SEQ ID NO: 3929 - protein, 30 aa, synthetic construct
  REGION 1..30: note = TNR1B Linker (13-42)
AVHLPQPVSTRSQHTQPTPEPSTAPSTSFL

SEQ ID NO: 3930 - protein, 29 aa, synthetic construct
  REGION 1..29: note = TNR1B Linker (14-42)
VHLPQPVSTRSQHTQPTPEPSTAPSTSFL

SEQ ID NO: 3931 - protein, 28 aa, synthetic construct
  REGION 1..28: note = TNR1B Linker (15-42)
HLPQPVSTRSQHTQPTPEPSTAPSTSFL

SEQ ID NO: 3932 - protein, 27 aa, synthetic construct
  REGION 1..27: note = TNR1B Linker (16-42)
LPQPVSTRSQHTQPTPEPSTAPSTSFL

SEQ ID NO: 3933 - protein, 26 aa, synthetic construct
  REGION 1..26: note = TNR1B Linker (17-42)
PQPVSTRSQHTQPTPEPSTAPSTSFL

SEQ ID NO: 3934 - protein, 25 aa, synthetic construct
  REGION 1..25: note = TNR1B Linker (18-42)
QPVSTRSQHTQPTPEPSTAPSTSFL

SEQ ID NO: 3935 - protein, 24 aa, synthetic construct
  REGION 1..24: note = TNR1B Linker (19-42)
PVSTRSQHTQPTPEPSTAPSTSFL

SEQ ID NO: 3936 - protein, 23 aa, synthetic construct
  REGION 1..23: note = TNR1B Linker (20-42)
VSTRSQHTQPTPEPSTAPSTSFL

SEQ ID NO: 3937 - protein, 22 aa, synthetic construct
  REGION 1..22: note = TNR1B Linker (21-42)
STRSQHTQPTPEPSTAPSTSFL

SEQ ID NO: 3938 - protein, 21 aa, synthetic construct
  REGION 1..21: note = TNR1B Linker (22-42)
TRSQHTQPTPEPSTAPSTSFL

SEQ ID NO: 3939 - protein, 20 aa, synthetic construct
  REGION 1..20: note = TNR1B Linker (23-42)
RSQHTQPTPEPSTAPSTSFL

SEQ ID NO: 3940 - protein, 19 aa, synthetic construct
  REGION 1..19: note = TNR1B Linker (24-42)
SQHTQPTPEPSTAPSTSFL

SEQ ID NO: 3941 - protein, 18 aa, synthetic construct
  REGION 1..18: note = TNR1B Linker (25-42)
QHTQPTPEPSTAPSTSFL

SEQ ID NO: 3942 - protein, 17 aa, synthetic construct
  REGION 1..17: note = TNR1B Linker (26-42)
HTQPTPEPSTAPSTSFL

SEQ ID NO: 3943 - protein, 16 aa, synthetic construct
  REGION 1..16: note = TNR1B Linker (27-42)
TQPTPEPSTAPSTSFL

SEQ ID NO: 3944 - protein, 15 aa, synthetic construct
  REGION 1..15: note = TNR1B Linker (28-42)
QPTPEPSTAPSTSFL

SEQ ID NO: 3945 - protein, 14 aa, synthetic construct
  REGION 1..14: note = TNR1B Linker (29-42)
PTPEPSTAPSTSFL

SEQ ID NO: 3946 - protein, 13 aa, synthetic construct
  REGION 1..13: note = TNR1B Linker (30-42)
TPEPSTAPSTSFL

SEQ ID NO: 3947 - protein, 12 aa, synthetic construct
  REGION 1..12: note = TNR1B Linker (31-42)
PEPSTAPSTSFL

SEQ ID NO: 3948 - protein, 11 aa, synthetic construct
  REGION 1..11: note = TNR1B Linker (32-42)
EPSTAPSTSFL

SEQ ID NO: 3949 - protein, 10 aa, synthetic construct
  REGION 1..10: note = TNR1B Linker (33-42)
PSTAPSTSFL

SEQ ID NO: 3950 - protein, 9 aa, synthetic construct
  REGION 1..9: note = TNR1B Linker (34-42)
STAPSTSFL

SEQ ID NO: 3951 - protein, 8 aa, synthetic construct
  REGION 1..8: note = TNR1B Linker (35-42)
TAPSTSFL

SEQ ID NO: 3952 - protein, 7 aa, synthetic construct
  REGION 1..7: note = TNR1B Linker (36-42)
APSTSFL

SEQ ID NO: 3953 - protein, 6 aa, synthetic construct
  REGION 1..6: note = TNR1B Linker (37-42)
PSTSFL

SEQ ID NO: 3954 - protein, 5 aa, synthetic construct
  REGION 1..5: note = TNR1B Linker (38-42)
STSFL

SEQ ID NO: 3955 - protein, 41 aa, synthetic construct
  REGION 1..41: note = TNR1B Linker (1-41)
TSTSPTRSMAPGAVHLPQPVSTRSQHTQPTPEPSTAPSTSF

SEQ ID NO: 3956 - protein, 40 aa, synthetic construct
  REGION 1..40: note = TNR1B Linker (2-41)
STSPTRSMAPGAVHLPQPVSTRSQHTQPTPEPSTAPSTSF

SEQ ID NO: 3957 - protein, 39 aa, synthetic construct
  REGION 1..39: note = TNR1B Linker (3-41)
TSPTRSMAPGAVHLPQPVSTRSQHTQPTPEPSTAPSTSF

SEQ ID NO: 3958 - protein, 38 aa, synthetic construct
  REGION 1..38: note = TNR1B Linker (4-41)
SPTRSMAPGAVHLPQPVSTRSQHTQPTPEPSTAPSTSF

SEQ ID NO: 3959 - protein, 37 aa, synthetic construct
  REGION 1..37: note = TNR1B Linker (5-41)
PTRSMAPGAVHLPQPVSTRSQHTQPTPEPSTAPSTSF

SEQ ID NO: 3960 - protein, 36 aa, synthetic construct
  REGION 1..36: note = TNR1B Linker (6-41)
TRSMAPGAVHLPQPVSTRSQHTQPTPEPSTAPSTSF

SEQ ID NO: 3961 - protein, 35 aa, synthetic construct
  REGION 1..35: note = TNR1B Linker (7-41)
RSMAPGAVHLPQPVSTRSQHTQPTPEPSTAPSTSF

SEQ ID NO: 3962 - protein, 34 aa, synthetic construct
  REGION 1..34: note = TNR1B Linker (8-41)
SMAPGAVHLPQPVSTRSQHTQPTPEPSTAPSTSF

SEQ ID NO: 3963 - protein, 33 aa, synthetic construct
  REGION 1..33: note = TNR1B Linker (9-41)
MAPGAVHLPQPVSTRSQHTQPTPEPSTAPSTSF

SEQ ID NO: 3964 - protein, 32 aa, synthetic construct
  REGION 1..32: note = TNR1B Linker (10-41)
APGAVHLPQPVSTRSQHTQPTPEPSTAPSTSF

SEQ ID NO: 3965 - protein, 31 aa, synthetic construct
  REGION 1..31: note = TNR1B Linker (11-41)
PGAVHLPQPVSTRSQHTQPTPEPSTAPSTSF

SEQ ID NO: 3966 - protein, 30 aa, synthetic construct
  REGION 1..30: note = TNR1B Linker (12-41)
GAVHLPQPVSTRSQHTQPTPEPSTAPSTSF

SEQ ID NO: 3967 - protein, 29 aa, synthetic construct
  REGION 1..29: note = TNR1B Linker (13-41)
AVHLPQPVSTRSQHTQPTPEPSTAPSTSF

SEQ ID NO: 3968 - protein, 28 aa, synthetic construct
  REGION 1..28: note = TNR1B Linker (14-41)
VHLPQPVSTRSQHTQPTPEPSTAPSTSF

SEQ ID NO: 3969 - protein, 27 aa, synthetic construct
  REGION 1..27: note = TNR1B Linker (15-41)
HLPQPVSTRSQHTQPTPEPSTAPSTSF

SEQ ID NO: 3970 - protein, 26 aa, synthetic construct
  REGION 1..26: note = TNR1B Linker (16-41)
LPQPVSTRSQHTQPTPEPSTAPSTSF

SEQ ID NO: 3971 - protein, 25 aa, synthetic construct
  REGION 1..25: note = TNR1B Linker (17-41)
PQPVSTRSQHTQPTPEPSTAPSTSF

SEQ ID NO: 3972 - protein, 24 aa, synthetic construct
  REGION 1..24: note = TNR1B Linker (18-41)
QPVSTRSQHTQPTPEPSTAPSTSF

SEQ ID NO: 3973 - protein, 23 aa, synthetic construct
  REGION 1..23: note = TNR1B Linker (19-41)
PVSTRSQHTQPTPEPSTAPSTSF

SEQ ID NO: 3974 - protein, 22 aa, synthetic construct
  REGION 1..22: note = TNR1B Linker (20-41)
VSTRSQHTQPTPEPSTAPSTSF

SEQ ID NO: 3975 - protein, 21 aa, synthetic construct
  REGION 1..21: note = TNR1B Linker (21-41)
STRSQHTQPTPEPSTAPSTSF

SEQ ID NO: 3976 - protein, 20 aa, synthetic construct
  REGION 1..20: note = TNR1B Linker (22-41)
TRSQHTQPTPEPSTAPSTSF

SEQ ID NO: 3977 - protein, 19 aa, synthetic construct
  REGION 1..19: note = TNR1B Linker (23-41)
RSQHTQPTPEPSTAPSTSF

SEQ ID NO: 3978 - protein, 18 aa, synthetic construct
  REGION 1..18: note = TNR1B Linker (24-41)
SQHTQPTPEPSTAPSTSF

SEQ ID NO: 3979 - protein, 17 aa, synthetic construct
  REGION 1..17: note = TNR1B Linker (25-41)
QHTQPTPEPSTAPSTSF

SEQ ID NO: 3980 - protein, 16 aa, synthetic construct
  REGION 1..16: note = TNR1B Linker (26-41)
HTQPTPEPSTAPSTSF

SEQ ID NO: 3981 - protein, 15 aa, synthetic construct
  REGION 1..15: note = TNR1B Linker (27-41)
TQPTPEPSTAPSTSF

SEQ ID NO: 3982 - protein, 14 aa, synthetic construct
  REGION 1..14: note = TNR1B Linker (28-41)
QPTPEPSTAPSTSF

SEQ ID NO: 3983 - protein, 13 aa, synthetic construct
  REGION 1..13: note = TNR1B Linker (29-41)
PTPEPSTAPSTSF

SEQ ID NO: 3984 - protein, 12 aa, synthetic construct
  REGION 1..12: note = TNR1B Linker (30-41)
TPEPSTAPSTSF

SEQ ID NO: 3985 - protein, 11 aa, synthetic construct
  REGION 1..11: note = TNR1B Linker (31-41)
PEPSTAPSTSF

SEQ ID NO: 3986 - protein, 10 aa, synthetic construct
  REGION 1..10: note = TNR1B Linker (32-41)
EPSTAPSTSF

SEQ ID NO: 3987 - protein, 9 aa, synthetic construct
  REGION 1..9: note = TNR1B Linker (33-41)
PSTAPSTSF

SEQ ID NO: 3988 - protein, 8 aa, synthetic construct
  REGION 1..8: note = TNR1B Linker (34-41)
STAPSTSF

SEQ ID NO: 3989 - protein, 7 aa, synthetic construct
  REGION 1..7: note = TNR1B Linker (35-41)
TAPSTSF

SEQ ID NO: 3990 - protein, 6 aa, synthetic construct
  REGION 1..6: note = TNR1B Linker (36-41)
APSTSF

SEQ ID NO: 3991 - protein, 5 aa, synthetic construct
  REGION 1..5: note = TNR1B Linker (37-41)
PSTSF

SEQ ID NO: 3992 - protein, 40 aa, synthetic construct
  REGION 1..40: note = TNR1B Linker (1-40)
TSTSPTRSMAPGAVHLPQPVSTRSQHTQPTPEPSTAPSTS

SEQ ID NO: 3993 - protein, 39 aa, synthetic construct
  REGION 1..39: note = TNR1B Linker (2-40)
STSPTRSMAPGAVHLPQPVSTRSQHTQPTPEPSTAPSTS

SEQ ID NO: 3994 - protein, 38 aa, synthetic construct
  REGION 1..38: note = TNR1B Linker (3-40)
TSPTRSMAPGAVHLPQPVSTRSQHTQPTPEPSTAPSTS

SEQ ID NO: 3995 - protein, 37 aa, synthetic construct
  REGION 1..37: note = TNR1B Linker (4-40)
SPTRSMAPGAVHLPQPVSTRSQHTQPTPEPSTAPSTS

SEQ ID NO: 3996 - protein, 36 aa, synthetic construct
  REGION 1..36: note = TNR1B Linker (5-40)
PTRSMAPGAVHLPQPVSTRSQHTQPTPEPSTAPSTS

SEQ ID NO: 3997 - protein, 35 aa, synthetic construct
  REGION 1..35: note = TNR1B Linker (6-40)
TRSMAPGAVHLPQPVSTRSQHTQPTPEPSTAPSTS

SEQ ID NO: 3998 - protein, 34 aa, synthetic construct
  REGION 1..34: note = TNR1B Linker (7-40)
RSMAPGAVHLPQPVSTRSQHTQPTPEPSTAPSTS

SEQ ID NO: 3999 - protein, 33 aa, synthetic construct
  REGION 1..33: note = TNR1B Linker (8-40)
SMAPGAVHLPQPVSTRSQHTQPTPEPSTAPSTS

SEQ ID NO: 4000 - protein, 32 aa, synthetic construct
  REGION 1..32: note = TNR1B Linker (9-40)
MAPGAVHLPQPVSTRSQHTQPTPEPSTAPSTS

SEQ ID NO: 4001 - protein, 31 aa, synthetic construct
  REGION 1..31: note = TNR1B Linker (10-40)
APGAVHLPQPVSTRSQHTQPTPEPSTAPSTS

SEQ ID NO: 4002 - protein, 30 aa, synthetic construct
  REGION 1..30: note = TNR1B Linker (11-40)
PGAVHLPQPVSTRSQHTQPTPEPSTAPSTS

SEQ ID NO: 4003 - protein, 29 aa, synthetic construct
  REGION 1..29: note = TNR1B Linker (12-40)
GAVHLPQPVSTRSQHTQPTPEPSTAPSTS

SEQ ID NO: 4004 - protein, 28 aa, synthetic construct
  REGION 1..28: note = TNR1B Linker (13-40)
AVHLPQPVSTRSQHTQPTPEPSTAPSTS

SEQ ID NO: 4005 - protein, 27 aa, synthetic construct
  REGION 1..27: note = TNR1B Linker (14-40)
VHLPQPVSTRSQHTQPTPEPSTAPSTS

SEQ ID NO: 4006 - protein, 26 aa, synthetic construct
  REGION 1..26: note = TNR1B Linker (15-40)
HLPQPVSTRSQHTQPTPEPSTAPSTS

SEQ ID NO: 4007 - protein, 25 aa, synthetic construct
  REGION 1..25: note = TNR1B Linker (16-40)
LPQPVSTRSQHTQPTPEPSTAPSTS

SEQ ID NO: 4008 - protein, 24 aa, synthetic construct
  REGION 1..24: note = TNR1B Linker (17-40)
PQPVSTRSQHTQPTPEPSTAPSTS

SEQ ID NO: 4009 - protein, 23 aa, synthetic construct
  REGION 1..23: note = TNR1B Linker (18-40)
QPVSTRSQHTQPTPEPSTAPSTS

SEQ ID NO: 4010 - protein, 22 aa, synthetic construct
  REGION 1..22: note = TNR1B Linker (19-40)
PVSTRSQHTQPTPEPSTAPSTS

SEQ ID NO: 4011 - protein, 21 aa, synthetic construct
  REGION 1..21: note = TNR1B Linker (20-40)
VSTRSQHTQPTPEPSTAPSTS

SEQ ID NO: 4012 - protein, 20 aa, synthetic construct
  REGION 1..20: note = TNR1B Linker (21-40)
STRSQHTQPTPEPSTAPSTS

SEQ ID NO: 4013 - protein, 19 aa, synthetic construct
  REGION 1..19: note = TNR1B Linker (22-40)
TRSQHTQPTPEPSTAPSTS

SEQ ID NO: 4014 - protein, 18 aa, synthetic construct
  REGION 1..18: note = TNR1B Linker (23-40)
RSQHTQPTPEPSTAPSTS

SEQ ID NO: 4015 - protein, 17 aa, synthetic construct
  REGION 1..17: note = TNR1B Linker (24-40)
SQHTQPTPEPSTAPSTS

SEQ ID NO: 4016 - protein, 16 aa, synthetic construct
  REGION 1..16: note = TNR1B Linker (25-40)
QHTQPTPEPSTAPSTS

SEQ ID NO: 4017 - protein, 15 aa, synthetic construct
  REGION 1..15: note = TNR1B Linker (26-40)
HTQPTPEPSTAPSTS

SEQ ID NO: 4018 - protein, 14 aa, synthetic construct
  REGION 1..14: note = TNR1B Linker (27-40)
TQPTPEPSTAPSTS

SEQ ID NO: 4019 - protein, 13 aa, synthetic construct
  REGION 1..13: note = TNR1B Linker (28-40)
QPTPEPSTAPSTS

SEQ ID NO: 4020 - protein, 12 aa, synthetic construct
  REGION 1..12: note = TNR1B Linker (29-40)
PTPEPSTAPSTS

SEQ ID NO: 4021 - protein, 11 aa, synthetic construct
  REGION 1..11: note = TNR1B Linker (30-40)
TPEPSTAPSTS

SEQ ID NO: 4022 - protein, 10 aa, synthetic construct
  REGION 1..10: note = TNR1B Linker (31-40)
PEPSTAPSTS

SEQ ID NO: 4023 - protein, 9 aa, synthetic construct
  REGION 1..9: note = TNR1B Linker (32-40)
EPSTAPSTS

SEQ ID NO: 4024 - protein, 8 aa, synthetic construct
  REGION 1..8: note = TNR1B Linker (33-40)
PSTAPSTS

SEQ ID NO: 4025 - protein, 7 aa, synthetic construct
  REGION 1..7: note = TNR1B Linker (34-40)
STAPSTS

SEQ ID NO: 4026 - protein, 6 aa, synthetic construct
  REGION 1..6: note = TNR1B Linker (35-40)
TAPSTS

SEQ ID NO: 4027 - protein, 5 aa, synthetic construct
  REGION 1..5: note = TNR1B Linker (36-40)
APSTS

SEQ ID NO: 4028 - protein, 39 aa, synthetic construct
  REGION 1..39: note = TNR1B Linker (1-39)
TSTSPTRSMAPGAVHLPQPVSTRSQHTQPTPEPSTAPST

SEQ ID NO: 4029 - protein, 38 aa, synthetic construct
  REGION 1..38: note = TNR1B Linker (2-39)
STSPTRSMAPGAVHLPQPVSTRSQHTQPTPEPSTAPST

SEQ ID NO: 4030 - protein, 37 aa, synthetic construct
  REGION 1..37: note = TNR1B Linker (3-39)
TSPTRSMAPGAVHLPQPVSTRSQHTQPTPEPSTAPST

SEQ ID NO: 4031 - protein, 36 aa, synthetic construct
  REGION 1..36: note = TNR1B Linker (4-39)
SPTRSMAPGAVHLPQPVSTRSQHTQPTPEPSTAPST

SEQ ID NO: 4032 - protein, 35 aa, synthetic construct
  REGION 1..35: note = TNR1B Linker (5-39)
PTRSMAPGAVHLPQPVSTRSQHTQPTPEPSTAPST

SEQ ID NO: 4033 - protein, 34 aa, synthetic construct
  REGION 1..34: note = TNR1B Linker (6-39)
TRSMAPGAVHLPQPVSTRSQHTQPTPEPSTAPST

SEQ ID NO: 4034 - protein, 33 aa, synthetic construct
  REGION 1..33: note = TNR1B Linker (7-39)
RSMAPGAVHLPQPVSTRSQHTQPTPEPSTAPST

SEQ ID NO: 4035 - protein, 32 aa, synthetic construct
  REGION 1..32: note = TNR1B Linker (8-39)
SMAPGAVHLPQPVSTRSQHTQPTPEPSTAPST

SEQ ID NO: 4036 - protein, 31 aa, synthetic construct
  REGION 1..31: note = TNR1B Linker (9-39)
MAPGAVHLPQPVSTRSQHTQPTPEPSTAPST

SEQ ID NO: 4037 - protein, 30 aa, synthetic construct
  REGION 1..30: note = TNR1B Linker (10-39)
APGAVHLPQPVSTRSQHTQPTPEPSTAPST

SEQ ID NO: 4038 - protein, 29 aa, synthetic construct
  REGION 1..29: note = TNR1B Linker (11-39)
PGAVHLPQPVSTRSQHTQPTPEPSTAPST

SEQ ID NO: 4039 - protein, 28 aa, synthetic construct
  REGION 1..28: note = TNR1B Linker (12-39)
GAVHLPQPVSTRSQHTQPTPEPSTAPST

SEQ ID NO: 4040 - protein, 27 aa, synthetic construct
  REGION 1..27: note = TNR1B Linker (13-39)
AVHLPQPVSTRSQHTQPTPEPSTAPST

SEQ ID NO: 4041 - protein, 26 aa, synthetic construct
  REGION 1..26: note = TNR1B Linker (14-39)
VHLPQPVSTRSQHTQPTPEPSTAPST

SEQ ID NO: 4042 - protein, 25 aa, synthetic construct
  REGION 1..25: note = TNR1B Linker (15-39)
HLPQPVSTRSQHTQPTPEPSTAPST

SEQ ID NO: 4043 - protein, 24 aa, synthetic construct
  REGION 1..24: note = TNR1B Linker (16-39)
LPQPVSTRSQHTQPTPEPSTAPST

SEQ ID NO: 4044 - protein, 23 aa, synthetic construct
  REGION 1..23: note = TNR1B Linker (17-39)
PQPVSTRSQHTQPTPEPSTAPST

SEQ ID NO: 4045 - protein, 22 aa, synthetic construct
  REGION 1..22: note = TNR1B Linker (18-39)
QPVSTRSQHTQPTPEPSTAPST

SEQ ID NO: 4046 - protein, 21 aa, synthetic construct
  REGION 1..21: note = TNR1B Linker (19-39)
PVSTRSQHTQPTPEPSTAPST

SEQ ID NO: 4047 - protein, 20 aa, synthetic construct
  REGION 1..20: note = TNR1B Linker (20-39)
VSTRSQHTQPTPEPSTAPST

SEQ ID NO: 4048 - protein, 19 aa, synthetic construct
  REGION 1..19: note = TNR1B Linker (21-39)
STRSQHTQPTPEPSTAPST

SEQ ID NO: 4049 - protein, 18 aa, synthetic construct
  REGION 1..18: note = TNR1B Linker (22-39)
TRSQHTQPTPEPSTAPST

SEQ ID NO: 4050 - protein, 17 aa, synthetic construct
  REGION 1..17: note = TNR1B Linker (23-39)
RSQHTQPTPEPSTAPST

SEQ ID NO: 4051 - protein, 16 aa, synthetic construct
  REGION 1..16: note = TNR1B Linker (24-39)
SQHTQPTPEPSTAPST

SEQ ID NO: 4052 - protein, 15 aa, synthetic construct
  REGION 1..15: note = TNR1B Linker (25-39)
QHTQPTPEPSTAPST

SEQ ID NO: 4053 - protein, 14 aa, synthetic construct
  REGION 1..14: note = TNR1B Linker (26-39)
HTQPTPEPSTAPST

SEQ ID NO: 4054 - protein, 13 aa, synthetic construct
  REGION 1..13: note = TNR1B Linker (27-39)
TQPTPEPSTAPST

SEQ ID NO: 4055 - protein, 12 aa, synthetic construct
  REGION 1..12: note = TNR1B Linker (28-39)
QPTPEPSTAPST

SEQ ID NO: 4056 - protein, 11 aa, synthetic construct
  REGION 1..11: note = TNR1B Linker (29-39)
PTPEPSTAPST

SEQ ID NO: 4057 - protein, 10 aa, synthetic construct
  REGION 1..10: note = TNR1B Linker (30-39)
TPEPSTAPST

SEQ ID NO: 4058 - protein, 9 aa, synthetic construct
  REGION 1..9: note = TNR1B Linker (31-39)
PEPSTAPST

SEQ ID NO: 4059 - protein, 8 aa, synthetic construct
  REGION 1..8: note = TNR1B Linker (32-39)
EPSTAPST

SEQ ID NO: 4060 - protein, 7 aa, synthetic construct
  REGION 1..7: note = TNR1B Linker (33-39)
PSTAPST

SEQ ID NO: 4061 - protein, 6 aa, synthetic construct
  REGION 1..6: note = TNR1B Linker (34-39)
STAPST

SEQ ID NO: 4062 - protein, 5 aa, synthetic construct
  REGION 1..5: note = TNR1B Linker (35-39)
TAPST

SEQ ID NO: 4063 - protein, 38 aa, synthetic construct
  REGION 1..38: note = TNR1B Linker (1-38)
TSTSPTRSMAPGAVHLPQPVSTRSQHTQPTPEPSTAPS

SEQ ID NO: 4064 - protein, 37 aa, synthetic construct
  REGION 1..37: note = TNR1B Linker (2-38)
STSPTRSMAPGAVHLPQPVSTRSQHTQPTPEPSTAPS

SEQ ID NO: 4065 - protein, 36 aa, synthetic construct
  REGION 1..36: note = TNR1B Linker (3-38)
TSPTRSMAPGAVHLPQPVSTRSQHTQPTPEPSTAPS

SEQ ID NO: 4066 - protein, 35 aa, synthetic construct
  REGION 1..35: note = TNR1B Linker (4-38)
SPTRSMAPGAVHLPQPVSTRSQHTQPTPEPSTAPS

SEQ ID NO: 4067 - protein, 34 aa, synthetic construct
  REGION 1..34: note = TNR1B Linker (5-38)
PTRSMAPGAVHLPQPVSTRSQHTQPTPEPSTAPS

SEQ ID NO: 4068 - protein, 33 aa, synthetic construct
  REGION 1..33: note = TNR1B Linker (6-38)
TRSMAPGAVHLPQPVSTRSQHTQPTPEPSTAPS

SEQ ID NO: 4069 - protein, 32 aa, synthetic construct
  REGION 1..32: note = TNR1B Linker (7-38)
RSMAPGAVHLPQPVSTRSQHTQPTPEPSTAPS

SEQ ID NO: 4070 - protein, 31 aa, synthetic construct
  REGION 1..31: note = TNR1B Linker (8-38)
SMAPGAVHLPQPVSTRSQHTQPTPEPSTAPS

SEQ ID NO: 4071 - protein, 30 aa, synthetic construct
  REGION 1..30: note = TNR1B Linker (9-38)
MAPGAVHLPQPVSTRSQHTQPTPEPSTAPS

SEQ ID NO: 4072 - protein, 29 aa, synthetic construct
  REGION 1..29: note = TNR1B Linker (10-38)
APGAVHLPQPVSTRSQHTQPTPEPSTAPS

SEQ ID NO: 4073 - protein, 28 aa, synthetic construct
  REGION 1..28: note = TNR1B Linker (11-38)
PGAVHLPQPVSTRSQHTQPTPEPSTAPS

SEQ ID NO: 4074 - protein, 27 aa, synthetic construct
  REGION 1..27: note = TNR1B Linker (12-38)
GAVHLPQPVSTRSQHTQPTPEPSTAPS

SEQ ID NO: 4075 - protein, 26 aa, synthetic construct
  REGION 1..26: note = TNR1B Linker (13-38)
AVHLPQPVSTRSQHTQPTPEPSTAPS

SEQ ID NO: 4076 - protein, 25 aa, synthetic construct
  REGION 1..25: note = TNR1B Linker (14-38)
VHLPQPVSTRSQHTQPTPEPSTAPS

SEQ ID NO: 4077 - protein, 24 aa, synthetic construct
  REGION 1..24: note = TNR1B Linker (15-38)
HLPQPVSTRSQHTQPTPEPSTAPS

SEQ ID NO: 4078 - protein, 23 aa, synthetic construct
  REGION 1..23: note = TNR1B Linker (16-38)
LPQPVSTRSQHTQPTPEPSTAPS

SEQ ID NO: 4079 - protein, 22 aa, synthetic construct
  REGION 1..22: note = TNR1B Linker (17-38)
PQPVSTRSQHTQPTPEPSTAPS

SEQ ID NO: 4080 - protein, 21 aa, synthetic construct
  REGION 1..21: note = TNR1B Linker (18-38)
QPVSTRSQHTQPTPEPSTAPS

SEQ ID NO: 4081 - protein, 20 aa, synthetic construct
  REGION 1..20: note = TNR1B Linker (19-38)
PVSTRSQHTQPTPEPSTAPS

SEQ ID NO: 4082 - protein, 19 aa, synthetic construct
  REGION 1..19: note = TNR1B Linker (20-38)
VSTRSQHTQPTPEPSTAPS

SEQ ID NO: 4083 - protein, 18 aa, synthetic construct
  REGION 1..18: note = TNR1B Linker (21-38)
STRSQHTQPTPEPSTAPS

SEQ ID NO: 4084 - protein, 17 aa, synthetic construct
  REGION 1..17: note = TNR1B Linker (22-38)
TRSQHTQPTPEPSTAPS

SEQ ID NO: 4085 - protein, 16 aa, synthetic construct
  REGION 1..16: note = TNR1B Linker (23-38)
RSQHTQPTPEPSTAPS

SEQ ID NO: 4086 - protein, 15 aa, synthetic construct
  REGION 1..15: note = TNR1B Linker (24-38)
SQHTQPTPEPSTAPS

SEQ ID NO: 4087 - protein, 14 aa, synthetic construct
  REGION 1..14: note = TNR1B Linker (25-38)
QHTQPTPEPSTAPS

SEQ ID NO: 4088 - protein, 13 aa, synthetic construct
  REGION 1..13: note = TNR1B Linker (26-38)
HTQPTPEPSTAPS

SEQ ID NO: 4089 - protein, 12 aa, synthetic construct
  REGION 1..12: note = TNR1B Linker (27-38)
TQPTPEPSTAPS

SEQ ID NO: 4090 - protein, 11 aa, synthetic construct
  REGION 1..11: note = TNR1B Linker (28-38)
QPTPEPSTAPS

SEQ ID NO: 4091 - protein, 10 aa, synthetic construct
  REGION 1..10: note = TNR1B Linker (29-38)
PTPEPSTAPS

SEQ ID NO: 4092 - protein, 9 aa, synthetic construct
  REGION 1..9: note = TNR1B Linker (30-38)
TPEPSTAPS

SEQ ID NO: 4093 - protein, 8 aa, synthetic construct
  REGION 1..8: note = TNR1B Linker (31-38)
PEPSTAPS

SEQ ID NO: 4094 - protein, 7 aa, synthetic construct
  REGION 1..7: note = TNR1B Linker (32-38)
EPSTAPS

SEQ ID NO: 4095 - protein, 6 aa, synthetic construct
  REGION 1..6: note = TNR1B Linker (33-38)
PSTAPS

SEQ ID NO: 4096 - protein, 5 aa, synthetic construct
  REGION 1..5: note = TNR1B Linker (34-38)
STAPS

SEQ ID NO: 4097 - protein, 37 aa, synthetic construct
  REGION 1..37: note = TNR1B Linker (1-37)
TSTSPTRSMAPGAVHLPQPVSTRSQHTQPTPEPSTAP

SEQ ID NO: 4098 - protein, 36 aa, synthetic construct
  REGION 1..36: note = TNR1B Linker (2-37)
STSPTRSMAPGAVHLPQPVSTRSQHTQPTPEPSTAP

SEQ ID NO: 4099 - protein, 35 aa, synthetic construct
  REGION 1..35: note = TNR1B Linker (3-37)
TSPTRSMAPGAVHLPQPVSTRSQHTQPTPEPSTAP

SEQ ID NO: 4100 - protein, 34 aa, synthetic construct
  REGION 1..34: note = TNR1B Linker (4-37)
SPTRSMAPGAVHLPQPVSTRSQHTQPTPEPSTAP

SEQ ID NO: 4101 - protein, 33 aa, synthetic construct
  REGION 1..33: note = TNR1B Linker (5-37)
PTRSMAPGAVHLPQPVSTRSQHTQPTPEPSTAP

SEQ ID NO: 4102 - protein, 32 aa, synthetic construct
  REGION 1..32: note = TNR1B Linker (6-37)
TRSMAPGAVHLPQPVSTRSQHTQPTPEPSTAP

SEQ ID NO: 4103 - protein, 31 aa, synthetic construct
  REGION 1..31: note = TNR1B Linker (7-37)
RSMAPGAVHLPQPVSTRSQHTQPTPEPSTAP

SEQ ID NO: 4104 - protein, 30 aa, synthetic construct
  REGION 1..30: note = TNR1B Linker (8-37)
SMAPGAVHLPQPVSTRSQHTQPTPEPSTAP

SEQ ID NO: 4105 - protein, 29 aa, synthetic construct
  REGION 1..29: note = TNR1B Linker (9-37)
MAPGAVHLPQPVSTRSQHTQPTPEPSTAP

SEQ ID NO: 4106 - protein, 28 aa, synthetic construct
  REGION 1..28: note = TNR1B Linker (10-37)
APGAVHLPQPVSTRSQHTQPTPEPSTAP

SEQ ID NO: 4107 - protein, 27 aa, synthetic construct
  REGION 1..27: note = TNR1B Linker (11-37)
PGAVHLPQPVSTRSQHTQPTPEPSTAP

SEQ ID NO: 4108 - protein, 26 aa, synthetic construct
  REGION 1..26: note = TNR1B Linker (12-37)
GAVHLPQPVSTRSQHTQPTPEPSTAP

SEQ ID NO: 4109 - protein, 25 aa, synthetic construct
  REGION 1..25: note = TNR1B Linker (13-37)
AVHLPQPVSTRSQHTQPTPEPSTAP

SEQ ID NO: 4110 - protein, 24 aa, synthetic construct
  REGION 1..24: note = TNR1B Linker (14-37)
VHLPQPVSTRSQHTQPTPEPSTAP

SEQ ID NO: 4111 - protein, 23 aa, synthetic construct
  REGION 1..23: note = TNR1B Linker (15-37)
HLPQPVSTRSQHTQPTPEPSTAP

SEQ ID NO: 4112 - protein, 22 aa, synthetic construct
  REGION 1..22: note = TNR1B Linker (16-37)
LPQPVSTRSQHTQPTPEPSTAP

SEQ ID NO: 4113 - protein, 21 aa, synthetic construct
  REGION 1..21: note = TNR1B Linker (17-37)
PQPVSTRSQHTQPTPEPSTAP

SEQ ID NO: 4114 - protein, 20 aa, synthetic construct
  REGION 1..20: note = TNR1B Linker (18-37)
QPVSTRSQHTQPTPEPSTAP

SEQ ID NO: 4115 - protein, 19 aa, synthetic construct
  REGION 1..19: note = TNR1B Linker (19-37)
PVSTRSQHTQPTPEPSTAP

SEQ ID NO: 4116 - protein, 18 aa, synthetic construct
  REGION 1..18: note = TNR1B Linker (20-37)
VSTRSQHTQPTPEPSTAP

SEQ ID NO: 4117 - protein, 17 aa, synthetic construct
  REGION 1..17: note = TNR1B Linker (21-37)
STRSQHTQPTPEPSTAP

SEQ ID NO: 4118 - protein, 16 aa, synthetic construct
  REGION 1..16: note = TNR1B Linker (22-37)
TRSQHTQPTPEPSTAP

SEQ ID NO: 4119 - protein, 15 aa, synthetic construct
  REGION 1..15: note = TNR1B Linker (23-37)
RSQHTQPTPEPSTAP

SEQ ID NO: 4120 - protein, 14 aa, synthetic construct
  REGION 1..14: note = TNR1B Linker (24-37)
SQHTQPTPEPSTAP

SEQ ID NO: 4121 - protein, 13 aa, synthetic construct
  REGION 1..13: note = TNR1B Linker (25-37)
QHTQPTPEPSTAP

SEQ ID NO: 4122 - protein, 12 aa, synthetic construct
  REGION 1..12: note = TNR1B Linker (26-37)
HTQPTPEPSTAP

SEQ ID NO: 4123 - protein, 11 aa, synthetic construct
  REGION 1..11: note = TNR1B Linker (27-37)
TQPTPEPSTAP

SEQ ID NO: 4124 - protein, 10 aa, synthetic construct
  REGION 1..10: note = TNR1B Linker (28-37)
QPTPEPSTAP

SEQ ID NO: 4125 - protein, 9 aa, synthetic construct
  REGION 1..9: note = TNR1B Linker (29-37)
PTPEPSTAP

SEQ ID NO: 4126 - protein, 8 aa, synthetic construct
  REGION 1..8: note = TNR1B Linker (30-37)
TPEPSTAP

SEQ ID NO: 4127 - protein, 7 aa, synthetic construct
  REGION 1..7: note = TNR1B Linker (31-37)
PEPSTAP

SEQ ID NO: 4128 - protein, 6 aa, synthetic construct
  REGION 1..6: note = TNR1B Linker (32-37)
EPSTAP

SEQ ID NO: 4129 - protein, 5 aa, synthetic construct
  REGION 1..5: note = TNR1B Linker (33-37)
PSTAP

SEQ ID NO: 4130 - protein, 36 aa, synthetic construct
  REGION 1..36: note = TNR1B Linker (1-36)
TSTSPTRSMAPGAVHLPQPVSTRSQHTQPTPEPSTA

SEQ ID NO: 4131 - protein, 35 aa, synthetic construct
  REGION 1..35: note = TNR1B Linker (2-36)
STSPTRSMAPGAVHLPQPVSTRSQHTQPTPEPSTA

SEQ ID NO: 4132 - protein, 34 aa, synthetic construct
  REGION 1..34: note = TNR1B Linker (3-36)
TSPTRSMAPGAVHLPQPVSTRSQHTQPTPEPSTA

SEQ ID NO: 4133 - protein, 33 aa, synthetic construct
  REGION 1..33: note = TNR1B Linker (4-36)
SPTRSMAPGAVHLPQPVSTRSQHTQPTPEPSTA

SEQ ID NO: 4134 - protein, 32 aa, synthetic construct
  REGION 1..32: note = TNR1B Linker (5-36)
PTRSMAPGAVHLPQPVSTRSQHTQPTPEPSTA

SEQ ID NO: 4135 - protein, 31 aa, synthetic construct
  REGION 1..31: note = TNR1B Linker (6-36)
TRSMAPGAVHLPQPVSTRSQHTQPTPEPSTA

SEQ ID NO: 4136 - protein, 30 aa, synthetic construct
  REGION 1..30: note = TNR1B Linker (7-36)
RSMAPGAVHLPQPVSTRSQHTQPTPEPSTA

SEQ ID NO: 4137 - protein, 29 aa, synthetic construct
  REGION 1..29: note = TNR1B Linker (8-36)
SMAPGAVHLPQPVSTRSQHTQPTPEPSTA

SEQ ID NO: 4138 - protein, 28 aa, synthetic construct
  REGION 1..28: note = TNR1B Linker (9-36)
MAPGAVHLPQPVSTRSQHTQPTPEPSTA

SEQ ID NO: 4139 - protein, 27 aa, synthetic construct
  REGION 1..27: note = TNR1B Linker (10-36)
APGAVHLPQPVSTRSQHTQPTPEPSTA

SEQ ID NO: 4140 - protein, 26 aa, synthetic construct
  REGION 1..26: note = TNR1B Linker (11-36)
PGAVHLPQPVSTRSQHTQPTPEPSTA

SEQ ID NO: 4141 - protein, 25 aa, synthetic construct
  REGION 1..25: note = TNR1B Linker (12-36)
GAVHLPQPVSTRSQHTQPTPEPSTA

SEQ ID NO: 4142 - protein, 24 aa, synthetic construct
  REGION 1..24: note = TNR1B Linker (13-36)
AVHLPQPVSTRSQHTQPTPEPSTA

SEQ ID NO: 4143 - protein, 23 aa, synthetic construct
  REGION 1..23: note = TNR1B Linker (14-36)
VHLPQPVSTRSQHTQPTPEPSTA

SEQ ID NO: 4144 - protein, 22 aa, synthetic construct
  REGION 1..22: note = TNR1B Linker (15-36)
HLPQPVSTRSQHTQPTPEPSTA

SEQ ID NO: 4145 - protein, 21 aa, synthetic construct
  REGION 1..21: note = TNR1B Linker (16-36)
LPQPVSTRSQHTQPTPEPSTA

SEQ ID NO: 4146 - protein, 20 aa, synthetic construct
  REGION 1..20: note = TNR1B Linker (17-36)
PQPVSTRSQHTQPTPEPSTA

SEQ ID NO: 4147 - protein, 19 aa, synthetic construct
  REGION 1..19: note = TNR1B Linker (18-36)
QPVSTRSQHTQPTPEPSTA

SEQ ID NO: 4148 - protein, 18 aa, synthetic construct
  REGION 1..18: note = TNR1B Linker (19-36)
PVSTRSQHTQPTPEPSTA

SEQ ID NO: 4149 - protein, 17 aa, synthetic construct
  REGION 1..17: note = TNR1B Linker (20-36)
VSTRSQHTQPTPEPSTA

SEQ ID NO: 4150 - protein, 16 aa, synthetic construct
  REGION 1..16: note = TNR1B Linker (21-36)
STRSQHTQPTPEPSTA

SEQ ID NO: 4151 - protein, 15 aa, synthetic construct
  REGION 1..15: note = TNR1B Linker (22-36)
TRSQHTQPTPEPSTA

SEQ ID NO: 4152 - protein, 14 aa, synthetic construct
  REGION 1..14: note = TNR1B Linker (23-36)
RSQHTQPTPEPSTA

SEQ ID NO: 4153 - protein, 13 aa, synthetic construct
  REGION 1..13: note = TNR1B Linker (24-36)
SQHTQPTPEPSTA

SEQ ID NO: 4154 - protein, 12 aa, synthetic construct
  REGION 1..12: note = TNR1B Linker (25-36)
QHTQPTPEPSTA

SEQ ID NO: 4155 - protein, 11 aa, synthetic construct
  REGION 1..11: note = TNR1B Linker (26-36)
HTQPTPEPSTA

SEQ ID NO: 4156 - protein, 10 aa, synthetic construct
  REGION 1..10: note = TNR1B Linker (27-36)
TQPTPEPSTA

SEQ ID NO: 4157 - protein, 9 aa, synthetic construct
  REGION 1..9: note = TNR1B Linker (28-36)
QPTPEPSTA

SEQ ID NO: 4158 - protein, 8 aa, synthetic construct
  REGION 1..8: note = TNR1B Linker (29-36)
PTPEPSTA

SEQ ID NO: 4159 - protein, 7 aa, synthetic construct
  REGION 1..7: note = TNR1B Linker (30-36)
TPEPSTA

SEQ ID NO: 4160 - protein, 6 aa, synthetic construct
  REGION 1..6: note = TNR1B Linker (31-36)
PEPSTA

SEQ ID NO: 4161 - protein, 5 aa, synthetic construct
  REGION 1..5: note = TNR1B Linker (32-36)
EPSTA

SEQ ID NO: 4162 - protein, 35 aa, synthetic construct
  REGION 1..35: note = TNR1B Linker (1-35)
TSTSPTRSMAPGAVHLPQPVSTRSQHTQPTPEPST

SEQ ID NO: 4163 - protein, 34 aa, synthetic construct
  REGION 1..34: note = TNR1B Linker (2-35)
STSPTRSMAPGAVHLPQPVSTRSQHTQPTPEPST

SEQ ID NO: 4164 - protein, 33 aa, synthetic construct
  REGION 1..33: note = TNR1B Linker (3-35)
TSPTRSMAPGAVHLPQPVSTRSQHTQPTPEPST

SEQ ID NO: 4165 - protein, 32 aa, synthetic construct
  REGION 1..32: note = TNR1B Linker (4-35)
SPTRSMAPGAVHLPQPVSTRSQHTQPTPEPST

SEQ ID NO: 4166 - protein, 31 aa, synthetic construct
  REGION 1..31: note = TNR1B Linker (5-35)
PTRSMAPGAVHLPQPVSTRSQHTQPTPEPST

SEQ ID NO: 4167 - protein, 30 aa, synthetic construct
  REGION 1..30: note = TNR1B Linker (6-35)
TRSMAPGAVHLPQPVSTRSQHTQPTPEPST

SEQ ID NO: 4168 - protein, 29 aa, synthetic construct
  REGION 1..29: note = TNR1B Linker (7-35)
RSMAPGAVHLPQPVSTRSQHTQPTPEPST

SEQ ID NO: 4169 - protein, 28 aa, synthetic construct
  REGION 1..28: note = TNR1B Linker (8-35)
SMAPGAVHLPQPVSTRSQHTQPTPEPST

SEQ ID NO: 4170 - protein, 27 aa, synthetic construct
  REGION 1..27: note = TNR1B Linker (9-35)
MAPGAVHLPQPVSTRSQHTQPTPEPST

SEQ ID NO: 4171 - protein, 26 aa, synthetic construct
  REGION 1..26: note = TNR1B Linker (10-35)
APGAVHLPQPVSTRSQHTQPTPEPST

SEQ ID NO: 4172 - protein, 25 aa, synthetic construct
  REGION 1..25: note = TNR1B Linker (11-35)
PGAVHLPQPVSTRSQHTQPTPEPST

SEQ ID NO: 4173 - protein, 24 aa, synthetic construct
  REGION 1..24: note = TNR1B Linker (12-35)
GAVHLPQPVSTRSQHTQPTPEPST

SEQ ID NO: 4174 - protein, 23 aa, synthetic construct
  REGION 1..23: note = TNR1B Linker (13-35)
AVHLPQPVSTRSQHTQPTPEPST

SEQ ID NO: 4175 - protein, 22 aa, synthetic construct
  REGION 1..22: note = TNR1B Linker (14-35)
VHLPQPVSTRSQHTQPTPEPST

SEQ ID NO: 4176 - protein, 21 aa, synthetic construct
  REGION 1..21: note = TNR1B Linker (15-35)
HLPQPVSTRSQHTQPTPEPST

SEQ ID NO: 4177 - protein, 20 aa, synthetic construct
  REGION 1..20: note = TNR1B Linker (16-35)
LPQPVSTRSQHTQPTPEPST

SEQ ID NO: 4178 - protein, 19 aa, synthetic construct
  REGION 1..19: note = TNR1B Linker (17-35)
PQPVSTRSQHTQPTPEPST

SEQ ID NO: 4179 - protein, 18 aa, synthetic construct
  REGION 1..18: note = TNR1B Linker (18-35)
QPVSTRSQHTQPTPEPST

SEQ ID NO: 4180 - protein, 17 aa, synthetic construct
  REGION 1..17: note = TNR1B Linker (19-35)
PVSTRSQHTQPTPEPST

SEQ ID NO: 4181 - protein, 16 aa, synthetic construct
  REGION 1..16: note = TNR1B Linker (20-35)
VSTRSQHTQPTPEPST

SEQ ID NO: 4182 - protein, 15 aa, synthetic construct
  REGION 1..15: note = TNR1B Linker (21-35)
STRSQHTQPTPEPST

SEQ ID NO: 4183 - protein, 14 aa, synthetic construct
  REGION 1..14: note = TNR1B Linker (22-35)
TRSQHTQPTPEPST

SEQ ID NO: 4184 - protein, 13 aa, synthetic construct
  REGION 1..13: note = TNR1B Linker (23-35)
RSQHTQPTPEPST

SEQ ID NO: 4185 - protein, 12 aa, synthetic construct
  REGION 1..12: note = TNR1B Linker (24-35)
SQHTQPTPEPST

SEQ ID NO: 4186 - protein, 11 aa, synthetic construct
  REGION 1..11: note = TNR1B Linker (25-35)
QHTQPTPEPST

SEQ ID NO: 4187 - protein, 10 aa, synthetic construct
  REGION 1..10: note = TNR1B Linker (26-35)
HTQPTPEPST

SEQ ID NO: 4188 - protein, 9 aa, synthetic construct
  REGION 1..9: note = TNR1B Linker (27-35)
TQPTPEPST

SEQ ID NO: 4189 - protein, 8 aa, synthetic construct
  REGION 1..8: note = TNR1B Linker (28-35)
QPTPEPST

SEQ ID NO: 4190 - protein, 7 aa, synthetic construct
  REGION 1..7: note = TNR1B Linker (29-35)
PTPEPST

SEQ ID NO: 4191 - protein, 6 aa, synthetic construct
  REGION 1..6: note = TNR1B Linker (30-35)
TPEPST

SEQ ID NO: 4192 - protein, 5 aa, synthetic construct
  REGION 1..5: note = TNR1B Linker (31-35)
PEPST

SEQ ID NO: 4193 - protein, 34 aa, synthetic construct
  REGION 1..34: note = TNR1B Linker (1-34)
TSTSPTRSMAPGAVHLPQPVSTRSQHTQPTPEPS

SEQ ID NO: 4194 - protein, 33 aa, synthetic construct
  REGION 1..33: note = TNR1B Linker (2-34)
STSPTRSMAPGAVHLPQPVSTRSQHTQPTPEPS

SEQ ID NO: 4195 - protein, 32 aa, synthetic construct
  REGION 1..32: note = TNR1B Linker (3-34)
TSPTRSMAPGAVHLPQPVSTRSQHTQPTPEPS

SEQ ID NO: 4196 - protein, 31 aa, synthetic construct
  REGION 1..31: note = TNR1B Linker (4-34)
SPTRSMAPGAVHLPQPVSTRSQHTQPTPEPS

SEQ ID NO: 4197 - protein, 30 aa, synthetic construct
  REGION 1..30: note = TNR1B Linker (5-34)
PTRSMAPGAVHLPQPVSTRSQHTQPTPEPS

SEQ ID NO: 4198 - protein, 29 aa, synthetic construct
  REGION 1..29: note = TNR1B Linker (6-34)
TRSMAPGAVHLPQPVSTRSQHTQPTPEPS

SEQ ID NO: 4199 - protein, 28 aa, synthetic construct
  REGION 1..28: note = TNR1B Linker (7-34)
RSMAPGAVHLPQPVSTRSQHTQPTPEPS

SEQ ID NO: 4200 - protein, 27 aa, synthetic construct
  REGION 1..27: note = TNR1B Linker (8-34)
SMAPGAVHLPQPVSTRSQHTQPTPEPS

SEQ ID NO: 4201 - protein, 26 aa, synthetic construct
  REGION 1..26: note = TNR1B Linker (9-34)
MAPGAVHLPQPVSTRSQHTQPTPEPS

SEQ ID NO: 4202 - protein, 25 aa, synthetic construct
  REGION 1..25: note = TNR1B Linker (10-34)
APGAVHLPQPVSTRSQHTQPTPEPS

SEQ ID NO: 4203 - protein, 24 aa, synthetic construct
  REGION 1..24: note = TNR1B Linker (11-34)
PGAVHLPQPVSTRSQHTQPTPEPS

SEQ ID NO: 4204 - protein, 23 aa, synthetic construct
  REGION 1..23: note = TNR1B Linker (12-34)
GAVHLPQPVSTRSQHTQPTPEPS

SEQ ID NO: 4205 - protein, 22 aa, synthetic construct
  REGION 1..22: note = TNR1B Linker (13-34)
AVHLPQPVSTRSQHTQPTPEPS

SEQ ID NO: 4206 - protein, 21 aa, synthetic construct
  REGION 1..21: note = TNR1B Linker (14-34)
VHLPQPVSTRSQHTQPTPEPS

SEQ ID NO: 4207 - protein, 20 aa, synthetic construct
  REGION 1..20: note = TNR1B Linker (15-34)
HLPQPVSTRSQHTQPTPEPS

SEQ ID NO: 4208 - protein, 19 aa, synthetic construct
  REGION 1..19: note = TNR1B Linker (16-34)
LPQPVSTRSQHTQPTPEPS

SEQ ID NO: 4209 - protein, 18 aa, synthetic construct
  REGION 1..18: note = TNR1B Linker (17-34)
PQPVSTRSQHTQPTPEPS

SEQ ID NO: 4210 - protein, 17 aa, synthetic construct
  REGION 1..17: note = TNR1B Linker (18-34)
QPVSTRSQHTQPTPEPS

SEQ ID NO: 4211 - protein, 16 aa, synthetic construct
  REGION 1..16: note = TNR1B Linker (19-34)
PVSTRSQHTQPTPEPS

SEQ ID NO: 4212 - protein, 15 aa, synthetic construct
  REGION 1..15: note = TNR1B Linker (20-34)
VSTRSQHTQPTPEPS

SEQ ID NO: 4213 - protein, 14 aa, synthetic construct
  REGION 1..14: note = TNR1B Linker (21-34)
STRSQHTQPTPEPS

SEQ ID NO: 4214 - protein, 13 aa, synthetic construct
  REGION 1..13: note = TNR1B Linker (22-34)
TRSQHTQPTPEPS

SEQ ID NO: 4215 - protein, 12 aa, synthetic construct
  REGION 1..12: note = TNR1B Linker (23-34)
RSQHTQPTPEPS

SEQ ID NO: 4216 - protein, 11 aa, synthetic construct
  REGION 1..11: note = TNR1B Linker (24-34)
SQHTQPTPEPS

SEQ ID NO: 4217 - protein, 10 aa, synthetic construct
  REGION 1..10: note = TNR1B Linker (25-34)
QHTQPTPEPS

SEQ ID NO: 4218 - protein, 9 aa, synthetic construct
  REGION 1..9: note = TNR1B Linker (26-34)
HTQPTPEPS

SEQ ID NO: 4219 - protein, 8 aa, synthetic construct
  REGION 1..8: note = TNR1B Linker (27-34)
TQPTPEPS

SEQ ID NO: 4220 - protein, 7 aa, synthetic construct
  REGION 1..7: note = TNR1B Linker (28-34)
QPTPEPS

SEQ ID NO: 4221 - protein, 6 aa, synthetic construct
  REGION 1..6: note = TNR1B Linker (29-34)
PTPEPS

SEQ ID NO: 4222 - protein, 5 aa, synthetic construct
  REGION 1..5: note = TNR1B Linker (30-34)
TPEPS

SEQ ID NO: 4223 - protein, 33 aa, synthetic construct
  REGION 1..33: note = TNR1B Linker (1-33)
TSTSPTRSMAPGAVHLPQPVSTRSQHTQPTPEP

SEQ ID NO: 4224 - protein, 32 aa, synthetic construct
  REGION 1..32: note = TNR1B Linker (2-33)
STSPTRSMAPGAVHLPQPVSTRSQHTQPTPEP

SEQ ID NO: 4225 - protein, 31 aa, synthetic construct
  REGION 1..31: note = TNR1B Linker (3-33)
TSPTRSMAPGAVHLPQPVSTRSQHTQPTPEP

SEQ ID NO: 4226 - protein, 30 aa, synthetic construct
  REGION 1..30: note = TNR1B Linker (4-33)
SPTRSMAPGAVHLPQPVSTRSQHTQPTPEP

SEQ ID NO: 4227 - protein, 29 aa, synthetic construct
  REGION 1..29: note = TNR1B Linker (5-33)
PTRSMAPGAVHLPQPVSTRSQHTQPTPEP

SEQ ID NO: 4228 - protein, 28 aa, synthetic construct
  REGION 1..28: note = TNR1B Linker (6-33)
TRSMAPGAVHLPQPVSTRSQHTQPTPEP

SEQ ID NO: 4229 - protein, 27 aa, synthetic construct
  REGION 1..27: note = TNR1B Linker (7-33)
RSMAPGAVHLPQPVSTRSQHTQPTPEP

SEQ ID NO: 4230 - protein, 26 aa, synthetic construct
  REGION 1..26: note = TNR1B Linker (8-33)
SMAPGAVHLPQPVSTRSQHTQPTPEP

SEQ ID NO: 4231 - protein, 25 aa, synthetic construct
  REGION 1..25: note = TNR1B Linker (9-33)
MAPGAVHLPQPVSTRSQHTQPTPEP

SEQ ID NO: 4232 - protein, 24 aa, synthetic construct
  REGION 1..24: note = TNR1B Linker (10-33)
APGAVHLPQPVSTRSQHTQPTPEP

SEQ ID NO: 4233 - protein, 23 aa, synthetic construct
  REGION 1..23: note = TNR1B Linker (11-33)
PGAVHLPQPVSTRSQHTQPTPEP

SEQ ID NO: 4234 - protein, 22 aa, synthetic construct
  REGION 1..22: note = TNR1B Linker (12-33)
GAVHLPQPVSTRSQHTQPTPEP

SEQ ID NO: 4235 - protein, 21 aa, synthetic construct
  REGION 1..21: note = TNR1B Linker (13-33)
AVHLPQPVSTRSQHTQPTPEP

SEQ ID NO: 4236 - protein, 20 aa, synthetic construct
  REGION 1..20: note = TNR1B Linker (14-33)
VHLPQPVSTRSQHTQPTPEP

SEQ ID NO: 4237 - protein, 19 aa, synthetic construct
  REGION 1..19: note = TNR1B Linker (15-33)
HLPQPVSTRSQHTQPTPEP

SEQ ID NO: 4238 - protein, 18 aa, synthetic construct
  REGION 1..18: note = TNR1B Linker (16-33)
LPQPVSTRSQHTQPTPEP

SEQ ID NO: 4239 - protein, 17 aa, synthetic construct
  REGION 1..17: note = TNR1B Linker (17-33)
PQPVSTRSQHTQPTPEP

SEQ ID NO: 4240 - protein, 16 aa, synthetic construct
  REGION 1..16: note = TNR1B Linker (18-33)
QPVSTRSQHTQPTPEP

SEQ ID NO: 4241 - protein, 15 aa, synthetic construct
  REGION 1..15: note = TNR1B Linker (19-33)
PVSTRSQHTQPTPEP

SEQ ID NO: 4242 - protein, 14 aa, synthetic construct
  REGION 1..14: note = TNR1B Linker (20-33)
VSTRSQHTQPTPEP

SEQ ID NO: 4243 - protein, 13 aa, synthetic construct
  REGION 1..13: note = TNR1B Linker (21-33)
STRSQHTQPTPEP

SEQ ID NO: 4244 - protein, 12 aa, synthetic construct
  REGION 1..12: note = TNR1B Linker (22-33)
TRSQHTQPTPEP

SEQ ID NO: 4245 - protein, 11 aa, synthetic construct
  REGION 1..11: note = TNR1B Linker (23-33)
RSQHTQPTPEP

SEQ ID NO: 4246 - protein, 10 aa, synthetic construct
  REGION 1..10: note = TNR1B Linker (24-33)
SQHTQPTPEP

SEQ ID NO: 4247 - protein, 9 aa, synthetic construct
  REGION 1..9: note = TNR1B Linker (25-33)
QHTQPTPEP

SEQ ID NO: 4248 - protein, 8 aa, synthetic construct
  REGION 1..8: note = TNR1B Linker (26-33)
HTQPTPEP

SEQ ID NO: 4249 - protein, 7 aa, synthetic construct
  REGION 1..7: note = TNR1B Linker (27-33)
TQPTPEP

SEQ ID NO: 4250 - protein, 6 aa, synthetic construct
  REGION 1..6: note = TNR1B Linker (28-33)
QPTPEP

SEQ ID NO: 4251 - protein, 5 aa, synthetic construct
  REGION 1..5: note = TNR1B Linker (29-33)
PTPEP

SEQ ID NO: 4252 - protein, 32 aa, synthetic construct
  REGION 1..32: note = TNR1B Linker (1-32)
TSTSPTRSMAPGAVHLPQPVSTRSQHTQPTPE

SEQ ID NO: 4253 - protein, 31 aa, synthetic construct
  REGION 1..31: note = TNR1B Linker (2-32)
STSPTRSMAPGAVHLPQPVSTRSQHTQPTPE

SEQ ID NO: 4254 - protein, 30 aa, synthetic construct
  REGION 1..30: note = TNR1B Linker (3-32)
TSPTRSMAPGAVHLPQPVSTRSQHTQPTPE

SEQ ID NO: 4255 - protein, 29 aa, synthetic construct
  REGION 1..29: note = TNR1B Linker (4-32)
SPTRSMAPGAVHLPQPVSTRSQHTQPTPE

SEQ ID NO: 4256 - protein, 28 aa, synthetic construct
  REGION 1..28: note = TNR1B Linker (5-32)
PTRSMAPGAVHLPQPVSTRSQHTQPTPE

SEQ ID NO: 4257 - protein, 27 aa, synthetic construct
  REGION 1..27: note = TNR1B Linker (6-32)
TRSMAPGAVHLPQPVSTRSQHTQPTPE

SEQ ID NO: 4258 - protein, 26 aa, synthetic construct
  REGION 1..26: note = TNR1B Linker (7-32)
RSMAPGAVHLPQPVSTRSQHTQPTPE

SEQ ID NO: 4259 - protein, 25 aa, synthetic construct
  REGION 1..25: note = TNR1B Linker (8-32)
SMAPGAVHLPQPVSTRSQHTQPTPE

SEQ ID NO: 4260 - protein, 24 aa, synthetic construct
  REGION 1..24: note = TNR1B Linker (9-32)
MAPGAVHLPQPVSTRSQHTQPTPE

SEQ ID NO: 4261 - protein, 23 aa, synthetic construct
  REGION 1..23: note = TNR1B Linker (10-32)
APGAVHLPQPVSTRSQHTQPTPE

SEQ ID NO: 4262 - protein, 22 aa, synthetic construct
  REGION 1..22: note = TNR1B Linker (11-32)
PGAVHLPQPVSTRSQHTQPTPE

SEQ ID NO: 4263 - protein, 21 aa, synthetic construct
  REGION 1..21: note = TNR1B Linker (12-32)
GAVHLPQPVSTRSQHTQPTPE

SEQ ID NO: 4264 - protein, 20 aa, synthetic construct
  REGION 1..20: note = TNR1B Linker (13-32)
AVHLPQPVSTRSQHTQPTPE

SEQ ID NO: 4265 - protein, 19 aa, synthetic construct
  REGION 1..19: note = TNR1B Linker (14-32)
VHLPQPVSTRSQHTQPTPE

SEQ ID NO: 4266 - protein, 18 aa, synthetic construct
  REGION 1..18: note = TNR1B Linker (15-32)
HLPQPVSTRSQHTQPTPE

SEQ ID NO: 4267 - protein, 17 aa, synthetic construct
  REGION 1..17: note = TNR1B Linker (16-32)
LPQPVSTRSQHTQPTPE

SEQ ID NO: 4268 - protein, 16 aa, synthetic construct
  REGION 1..16: note = TNR1B Linker (17-32)
PQPVSTRSQHTQPTPE

SEQ ID NO: 4269 - protein, 15 aa, synthetic construct
  REGION 1..15: note = TNR1B Linker (18-32)
QPVSTRSQHTQPTPE

SEQ ID NO: 4270 - protein, 14 aa, synthetic construct
  REGION 1..14: note = TNR1B Linker (19-32)
PVSTRSQHTQPTPE

SEQ ID NO: 4271 - protein, 13 aa, synthetic construct
  REGION 1..13: note = TNR1B Linker (20-32)
VSTRSQHTQPTPE

SEQ ID NO: 4272 - protein, 12 aa, synthetic construct
  REGION 1..12: note = TNR1B Linker (21-32)
STRSQHTQPTPE

SEQ ID NO: 4273 - protein, 11 aa, synthetic construct
  REGION 1..11: note = TNR1B Linker (22-32)
TRSQHTQPTPE

SEQ ID NO: 4274 - protein, 10 aa, synthetic construct
  REGION 1..10: note = TNR1B Linker (23-32)
RSQHTQPTPE

SEQ ID NO: 4275 - protein, 9 aa, synthetic construct
  REGION 1..9: note = TNR1B Linker (24-32)
SQHTQPTPE

SEQ ID NO: 4276 - protein, 8 aa, synthetic construct
  REGION 1..8: note = TNR1B Linker (25-32)
QHTQPTPE

SEQ ID NO: 4277 - protein, 7 aa, synthetic construct
  REGION 1..7: note = TNR1B Linker (26-32)
HTQPTPE

SEQ ID NO: 4278 - protein, 6 aa, synthetic construct
  REGION 1..6: note = TNR1B Linker (27-32)
TQPTPE

SEQ ID NO: 4279 - protein, 5 aa, synthetic construct
  REGION 1..5: note = TNR1B Linker (28-32)
QPTPE

SEQ ID NO: 4280 - protein, 31 aa, synthetic construct
  REGION 1..31: note = TNR1B Linker (1-31)
TSTSPTRSMAPGAVHLPQPVSTRSQHTQPTP

SEQ ID NO: 4281 - protein, 30 aa, synthetic construct
  REGION 1..30: note = TNR1B Linker (2-31)
STSPTRSMAPGAVHLPQPVSTRSQHTQPTP

SEQ ID NO: 4282 - protein, 29 aa, synthetic construct
  REGION 1..29: note = TNR1B Linker (3-31)
TSPTRSMAPGAVHLPQPVSTRSQHTQPTP

SEQ ID NO: 4283 - protein, 28 aa, synthetic construct
  REGION 1..28: note = TNR1B Linker (4-31)
SPTRSMAPGAVHLPQPVSTRSQHTQPTP

SEQ ID NO: 4284 - protein, 27 aa, synthetic construct
  REGION 1..27: note = TNR1B Linker (5-31)
PTRSMAPGAVHLPQPVSTRSQHTQPTP

SEQ ID NO: 4285 - protein, 26 aa, synthetic construct
  REGION 1..26: note = TNR1B Linker (6-31)
TRSMAPGAVHLPQPVSTRSQHTQPTP

SEQ ID NO: 4286 - protein, 25 aa, synthetic construct
  REGION 1..25: note = TNR1B Linker (7-31)
RSMAPGAVHLPQPVSTRSQHTQPTP

SEQ ID NO: 4287 - protein, 24 aa, synthetic construct
  REGION 1..24: note = TNR1B Linker (8-31)
SMAPGAVHLPQPVSTRSQHTQPTP

SEQ ID NO: 4288 - protein, 23 aa, synthetic construct
  REGION 1..23: note = TNR1B Linker (9-31)
MAPGAVHLPQPVSTRSQHTQPTP

SEQ ID NO: 4289 - protein, 22 aa, synthetic construct
  REGION 1..22: note = TNR1B Linker (10-31)
APGAVHLPQPVSTRSQHTQPTP

SEQ ID NO: 4290 - protein, 21 aa, synthetic construct
  REGION 1..21: note = TNR1B Linker (11-31)
PGAVHLPQPVSTRSQHTQPTP

SEQ ID NO: 4291 - protein, 20 aa, synthetic construct
  REGION 1..20: note = TNR1B Linker (12-31)
GAVHLPQPVSTRSQHTQPTP

SEQ ID NO: 4292 - protein, 19 aa, synthetic construct
  REGION 1..19: note = TNR1B Linker (13-31)
AVHLPQPVSTRSQHTQPTP

SEQ ID NO: 4293 - protein, 18 aa, synthetic construct
  REGION 1..18: note = TNR1B Linker (14-31)
VHLPQPVSTRSQHTQPTP

SEQ ID NO: 4294 - protein, 17 aa, synthetic construct
  REGION 1..17: note = TNR1B Linker (15-31)
HLPQPVSTRSQHTQPTP

SEQ ID NO: 4295 - protein, 16 aa, synthetic construct
  REGION 1..16: note = TNR1B Linker (16-31)
LPQPVSTRSQHTQPTP

SEQ ID NO: 4296 - protein, 15 aa, synthetic construct
  REGION 1..15: note = TNR1B Linker (17-31)
PQPVSTRSQHTQPTP

SEQ ID NO: 4297 - protein, 14 aa, synthetic construct
  REGION 1..14: note = TNR1B Linker (18-31)
QPVSTRSQHTQPTP

SEQ ID NO: 4298 - protein, 13 aa, synthetic construct
  REGION 1..13: note = TNR1B Linker (19-31)
PVSTRSQHTQPTP

SEQ ID NO: 4299 - protein, 12 aa, synthetic construct
  REGION 1..12: note = TNR1B Linker (20-31)
VSTRSQHTQPTP

SEQ ID NO: 4300 - protein, 11 aa, synthetic construct
  REGION 1..11: note = TNR1B Linker (21-31)
STRSQHTQPTP

SEQ ID NO: 4301 - protein, 10 aa, synthetic construct
  REGION 1..10: note = TNR1B Linker (22-31)
TRSQHTQPTP

SEQ ID NO: 4302 - protein, 9 aa, synthetic construct
  REGION 1..9: note = TNR1B Linker (23-31)
RSQHTQPTP

SEQ ID NO: 4303 - protein, 8 aa, synthetic construct
  REGION 1..8: note = TNR1B Linker (24-31)
SQHTQPTP

SEQ ID NO: 4304 - protein, 7 aa, synthetic construct
  REGION 1..7: note = TNR1B Linker (25-31)
QHTQPTP

SEQ ID NO: 4305 - protein, 6 aa, synthetic construct
  REGION 1..6: note = TNR1B Linker (26-31)
HTQPTP

SEQ ID NO: 4306 - protein, 5 aa, synthetic construct
  REGION 1..5: note = TNR1B Linker (27-31)
TQPTP

SEQ ID NO: 4307 - protein, 30 aa, synthetic construct
  REGION 1..30: note = TNR1B Linker (1-30)
TSTSPTRSMAPGAVHLPQPVSTRSQHTQPT

SEQ ID NO: 4308 - protein, 29 aa, synthetic construct
  REGION 1..29: note = TNR1B Linker (2-30)
STSPTRSMAPGAVHLPQPVSTRSQHTQPT

SEQ ID NO: 4309 - protein, 28 aa, synthetic construct
  REGION 1..28: note = TNR1B Linker (3-30)
TSPTRSMAPGAVHLPQPVSTRSQHTQPT

SEQ ID NO: 4310 - protein, 27 aa, synthetic construct
  REGION 1..27: note = TNR1B Linker (4-30)
SPTRSMAPGAVHLPQPVSTRSQHTQPT

SEQ ID NO: 4311 - protein, 26 aa, synthetic construct
  REGION 1..26: note = TNR1B Linker (5-30)
PTRSMAPGAVHLPQPVSTRSQHTQPT

SEQ ID NO: 4312 - protein, 25 aa, synthetic construct
  REGION 1..25: note = TNR1B Linker (6-30)
TRSMAPGAVHLPQPVSTRSQHTQPT

SEQ ID NO: 4313 - protein, 24 aa, synthetic construct
  REGION 1..24: note = TNR1B Linker (7-30)
RSMAPGAVHLPQPVSTRSQHTQPT

SEQ ID NO: 4314 - protein, 23 aa, synthetic construct
  REGION 1..23: note = TNR1B Linker (8-30)
SMAPGAVHLPQPVSTRSQHTQPT

SEQ ID NO: 4315 - protein, 22 aa, synthetic construct
  REGION 1..22: note = TNR1B Linker (9-30)
MAPGAVHLPQPVSTRSQHTQPT

SEQ ID NO: 4316 - protein, 21 aa, synthetic construct
  REGION 1..21: note = TNR1B Linker (10-30)
APGAVHLPQPVSTRSQHTQPT

SEQ ID NO: 4317 - protein, 20 aa, synthetic construct
  REGION 1..20: note = TNR1B Linker (11-30)
PGAVHLPQPVSTRSQHTQPT

SEQ ID NO: 4318 - protein, 19 aa, synthetic construct
  REGION 1..19: note = TNR1B Linker (12-30)
GAVHLPQPVSTRSQHTQPT

SEQ ID NO: 4319 - protein, 18 aa, synthetic construct
  REGION 1..18: note = TNR1B Linker (13-30)
AVHLPQPVSTRSQHTQPT

SEQ ID NO: 4320 - protein, 17 aa, synthetic construct
  REGION 1..17: note = TNR1B Linker (14-30)
VHLPQPVSTRSQHTQPT

SEQ ID NO: 4321 - protein, 16 aa, synthetic construct
  REGION 1..16: note = TNR1B Linker (15-30)
HLPQPVSTRSQHTQPT

SEQ ID NO: 4322 - protein, 15 aa, synthetic construct
  REGION 1..15: note = TNR1B Linker (16-30)
LPQPVSTRSQHTQPT

SEQ ID NO: 4323 - protein, 14 aa, synthetic construct
  REGION 1..14: note = TNR1B Linker (17-30)
PQPVSTRSQHTQPT

SEQ ID NO: 4324 - protein, 13 aa, synthetic construct
  REGION 1..13: note = TNR1B Linker (18-30)
QPVSTRSQHTQPT

SEQ ID NO: 4325 - protein, 12 aa, synthetic construct
  REGION 1..12: note = TNR1B Linker (19-30)
PVSTRSQHTQPT

SEQ ID NO: 4326 - protein, 11 aa, synthetic construct
  REGION 1..11: note = TNR1B Linker (20-30)
VSTRSQHTQPT

SEQ ID NO: 4327 - protein, 10 aa, synthetic construct
  REGION 1..10: note = TNR1B Linker (21-30)
STRSQHTQPT

SEQ ID NO: 4328 - protein, 9 aa, synthetic construct
  REGION 1..9: note = TNR1B Linker (22-30)
TRSQHTQPT

SEQ ID NO: 4329 - protein, 8 aa, synthetic construct
  REGION 1..8: note = TNR1B Linker (23-30)
RSQHTQPT

SEQ ID NO: 4330 - protein, 7 aa, synthetic construct
  REGION 1..7: note = TNR1B Linker (24-30)
SQHTQPT

SEQ ID NO: 4331 - protein, 6 aa, synthetic construct
  REGION 1..6: note = TNR1B Linker (25-30)
QHTQPT

SEQ ID NO: 4332 - protein, 5 aa, synthetic construct
  REGION 1..5: note = TNR1B Linker (26-30)
HTQPT

SEQ ID NO: 4333 - protein, 29 aa, synthetic construct
  REGION 1..29: note = TNR1B Linker (1-29)
TSTSPTRSMAPGAVHLPQPVSTRSQHTQP

SEQ ID NO: 4334 - protein, 28 aa, synthetic construct
  REGION 1..28: note = TNR1B Linker (2-29)
STSPTRSMAPGAVHLPQPVSTRSQHTQP

SEQ ID NO: 4335 - protein, 27 aa, synthetic construct
  REGION 1..27: note = TNR1B Linker (3-29)
TSPTRSMAPGAVHLPQPVSTRSQHTQP

SEQ ID NO: 4336 - protein, 26 aa, synthetic construct
  REGION 1..26: note = TNR1B Linker (4-29)
SPTRSMAPGAVHLPQPVSTRSQHTQP

SEQ ID NO: 4337 - protein, 25 aa, synthetic construct
  REGION 1..25: note = TNR1B Linker (5-29)
PTRSMAPGAVHLPQPVSTRSQHTQP

SEQ ID NO: 4338 - protein, 24 aa, synthetic construct
  REGION 1..24: note = TNR1B Linker (6-29)
TRSMAPGAVHLPQPVSTRSQHTQP

SEQ ID NO: 4339 - protein, 23 aa, synthetic construct
  REGION 1..23: note = TNR1B Linker (7-29)
RSMAPGAVHLPQPVSTRSQHTQP

SEQ ID NO: 4340 - protein, 22 aa, synthetic construct
  REGION 1..22: note = TNR1B Linker (8-29)
SMAPGAVHLPQPVSTRSQHTQP

SEQ ID NO: 4341 - protein, 21 aa, synthetic construct
  REGION 1..21: note = TNR1B Linker (9-29)
MAPGAVHLPQPVSTRSQHTQP

SEQ ID NO: 4342 - protein, 20 aa, synthetic construct
  REGION 1..20: note = TNR1B Linker (10-29)
APGAVHLPQPVSTRSQHTQP

SEQ ID NO: 4343 - protein, 19 aa, synthetic construct
  REGION 1..19: note = TNR1B Linker (11-29)
PGAVHLPQPVSTRSQHTQP

SEQ ID NO: 4344 - protein, 18 aa, synthetic construct
  REGION 1..18: note = TNR1B Linker (12-29)
GAVHLPQPVSTRSQHTQP

SEQ ID NO: 4345 - protein, 17 aa, synthetic construct
  REGION 1..17: note = TNR1B Linker (13-29)
AVHLPQPVSTRSQHTQP

SEQ ID NO: 4346 - protein, 16 aa, synthetic construct
  REGION 1..16: note = TNR1B Linker (14-29)
VHLPQPVSTRSQHTQP

SEQ ID NO: 4347 - protein, 15 aa, synthetic construct
  REGION 1..15: note = TNR1B Linker (15-29)
HLPQPVSTRSQHTQP

SEQ ID NO: 4348 - protein, 14 aa, synthetic construct
  REGION 1..14: note = TNR1B Linker (16-29)
LPQPVSTRSQHTQP

SEQ ID NO: 4349 - protein, 13 aa, synthetic construct
  REGION 1..13: note = TNR1B Linker (17-29)
PQPVSTRSQHTQP

SEQ ID NO: 4350 - protein, 12 aa, synthetic construct
  REGION 1..12: note = TNR1B Linker (18-29)
QPVSTRSQHTQP

SEQ ID NO: 4351 - protein, 11 aa, synthetic construct
  REGION 1..11: note = TNR1B Linker (19-29)
PVSTRSQHTQP

SEQ ID NO: 4352 - protein, 10 aa, synthetic construct
  REGION 1..10: note = TNR1B Linker (20-29)
VSTRSQHTQP

SEQ ID NO: 4353 - protein, 9 aa, synthetic construct
  REGION 1..9: note = TNR1B Linker (21-29)
STRSQHTQP

SEQ ID NO: 4354 - protein, 8 aa, synthetic construct
  REGION 1..8: note = TNR1B Linker (22-29)
TRSQHTQP

SEQ ID NO: 4355 - protein, 7 aa, synthetic construct
  REGION 1..7: note = TNR1B Linker (23-29)
RSQHTQP

SEQ ID NO: 4356 - protein, 6 aa, synthetic construct
  REGION 1..6: note = TNR1B Linker (24-29)
SQHTQP

SEQ ID NO: 4357 - protein, 5 aa, synthetic construct
  REGION 1..5: note = TNR1B Linker (25-29)
QHTQP

SEQ ID NO: 4358 - protein, 28 aa, synthetic construct
  REGION 1..28: note = TNR1B Linker (1-28)
TSTSPTRSMAPGAVHLPQPVSTRSQHTQ

SEQ ID NO: 4359 - protein, 27 aa, synthetic construct
  REGION 1..27: note = TNR1B Linker (2-28)
STSPTRSMAPGAVHLPQPVSTRSQHTQ

SEQ ID NO: 4360 - protein, 26 aa, synthetic construct
  REGION 1..26: note = TNR1B Linker (3-28)
TSPTRSMAPGAVHLPQPVSTRSQHTQ

SEQ ID NO: 4361 - protein, 25 aa, synthetic construct
  REGION 1..25: note = TNR1B Linker (4-28)
SPTRSMAPGAVHLPQPVSTRSQHTQ

SEQ ID NO: 4362 - protein, 24 aa, synthetic construct
  REGION 1..24: note = TNR1B Linker (5-28)
PTRSMAPGAVHLPQPVSTRSQHTQ

SEQ ID NO: 4363 - protein, 23 aa, synthetic construct
  REGION 1..23: note = TNR1B Linker (6-28)
TRSMAPGAVHLPQPVSTRSQHTQ

SEQ ID NO: 4364 - protein, 22 aa, synthetic construct
  REGION 1..22: note = TNR1B Linker (7-28)
RSMAPGAVHLPQPVSTRSQHTQ

SEQ ID NO: 4365 - protein, 21 aa, synthetic construct
  REGION 1..21: note = TNR1B Linker (8-28)
SMAPGAVHLPQPVSTRSQHTQ

SEQ ID NO: 4366 - protein, 20 aa, synthetic construct
  REGION 1..20: note = TNR1B Linker (9-28)
MAPGAVHLPQPVSTRSQHTQ

SEQ ID NO: 4367 - protein, 19 aa, synthetic construct
  REGION 1..19: note = TNR1B Linker (10-28)
APGAVHLPQPVSTRSQHTQ

SEQ ID NO: 4368 - protein, 18 aa, synthetic construct
  REGION 1..18: note = TNR1B Linker (11-28)
PGAVHLPQPVSTRSQHTQ

SEQ ID NO: 4369 - protein, 17 aa, synthetic construct
  REGION 1..17: note = TNR1B Linker (12-28)
GAVHLPQPVSTRSQHTQ

SEQ ID NO: 4370 - protein, 16 aa, synthetic construct
  REGION 1..16: note = TNR1B Linker (13-28)
AVHLPQPVSTRSQHTQ

SEQ ID NO: 4371 - protein, 15 aa, synthetic construct
  REGION 1..15: note = TNR1B Linker (14-28)
VHLPQPVSTRSQHTQ

SEQ ID NO: 4372 - protein, 14 aa, synthetic construct
  REGION 1..14: note = TNR1B Linker (15-28)
HLPQPVSTRSQHTQ

SEQ ID NO: 4373 - protein, 13 aa, synthetic construct
  REGION 1..13: note = TNR1B Linker (16-28)
LPQPVSTRSQHTQ

SEQ ID NO: 4374 - protein, 12 aa, synthetic construct
  REGION 1..12: note = TNR1B Linker (17-28)
PQPVSTRSQHTQ

SEQ ID NO: 4375 - protein, 11 aa, synthetic construct
  REGION 1..11: note = TNR1B Linker (18-28)
QPVSTRSQHTQ

SEQ ID NO: 4376 - protein, 10 aa, synthetic construct
  REGION 1..10: note = TNR1B Linker (19-28)
PVSTRSQHTQ

SEQ ID NO: 4377 - protein, 9 aa, synthetic construct
  REGION 1..9: note = TNR1B Linker (20-28)
VSTRSQHTQ

SEQ ID NO: 4378 - protein, 8 aa, synthetic construct
  REGION 1..8: note = TNR1B Linker (21-28)
STRSQHTQ

SEQ ID NO: 4379 - protein, 7 aa, synthetic construct
  REGION 1..7: note = TNR1B Linker (22-28)
TRSQHTQ

SEQ ID NO: 4380 - protein, 6 aa, synthetic construct
  REGION 1..6: note = TNR1B Linker (23-28)
RSQHTQ

SEQ ID NO: 4381 - protein, 5 aa, synthetic construct
  REGION 1..5: note = TNR1B Linker (24-28)
SQHTQ

SEQ ID NO: 4382 - protein, 27 aa, synthetic construct
  REGION 1..27: note = TNR1B Linker (1-27)
TSTSPTRSMAPGAVHLPQPVSTRSQHT

SEQ ID NO: 4383 - protein, 26 aa, synthetic construct
  REGION 1..26: note = TNR1B Linker (2-27)
STSPTRSMAPGAVHLPQPVSTRSQHT

SEQ ID NO: 4384 - protein, 25 aa, synthetic construct
  REGION 1..25: note = TNR1B Linker (3-27)
TSPTRSMAPGAVHLPQPVSTRSQHT

SEQ ID NO: 4385 - protein, 24 aa, synthetic construct
  REGION 1..24: note = TNR1B Linker (4-27)
SPTRSMAPGAVHLPQPVSTRSQHT

SEQ ID NO: 4386 - protein, 23 aa, synthetic construct
  REGION 1..23: note = TNR1B Linker (5-27)
PTRSMAPGAVHLPQPVSTRSQHT

SEQ ID NO: 4387 - protein, 22 aa, synthetic construct
  REGION 1..22: note = TNR1B Linker (6-27)
TRSMAPGAVHLPQPVSTRSQHT

SEQ ID NO: 4388 - protein, 21 aa, synthetic construct
  REGION 1..21: note = TNR1B Linker (7-27)
RSMAPGAVHLPQPVSTRSQHT

SEQ ID NO: 4389 - protein, 20 aa, synthetic construct
  REGION 1..20: note = TNR1B Linker (8-27)
SMAPGAVHLPQPVSTRSQHT

SEQ ID NO: 4390 - protein, 19 aa, synthetic construct
  REGION 1..19: note = TNR1B Linker (9-27)
MAPGAVHLPQPVSTRSQHT

SEQ ID NO: 4391 - protein, 18 aa, synthetic construct
  REGION 1..18: note = TNR1B Linker (10-27)
APGAVHLPQPVSTRSQHT

SEQ ID NO: 4392 - protein, 17 aa, synthetic construct
  REGION 1..17: note = TNR1B Linker (11-27)
PGAVHLPQPVSTRSQHT

SEQ ID NO: 4393 - protein, 16 aa, synthetic construct
  REGION 1..16: note = TNR1B Linker (12-27)
GAVHLPQPVSTRSQHT

SEQ ID NO: 4394 - protein, 15 aa, synthetic construct
  REGION 1..15: note = TNR1B Linker (13-27)
AVHLPQPVSTRSQHT

SEQ ID NO: 4395 - protein, 14 aa, synthetic construct
  REGION 1..14: note = TNR1B Linker (14-27)
VHLPQPVSTRSQHT

SEQ ID NO: 4396 - protein, 13 aa, synthetic construct
  REGION 1..13: note = TNR1B Linker (15-27)
HLPQPVSTRSQHT

SEQ ID NO: 4397 - protein, 12 aa, synthetic construct
  REGION 1..12: note = TNR1B Linker (16-27)
LPQPVSTRSQHT

SEQ ID NO: 4398 - protein, 11 aa, synthetic construct
  REGION 1..11: note = TNR1B Linker (17-27)
PQPVSTRSQHT

SEQ ID NO: 4399 - protein, 10 aa, synthetic construct
  REGION 1..10: note = TNR1B Linker (18-27)
QPVSTRSQHT

SEQ ID NO: 4400 - protein, 9 aa, synthetic construct
  REGION 1..9: note = TNR1B Linker (19-27)
PVSTRSQHT

SEQ ID NO: 4401 - protein, 8 aa, synthetic construct
  REGION 1..8: note = TNR1B Linker (20-27)
VSTRSQHT

SEQ ID NO: 4402 - protein, 7 aa, synthetic construct
  REGION 1..7: note = TNR1B Linker (21-27)
STRSQHT

SEQ ID NO: 4403 - protein, 6 aa, synthetic construct
  REGION 1..6: note = TNR1B Linker (22-27)
TRSQHT

SEQ ID NO: 4404 - protein, 5 aa, synthetic construct
  REGION 1..5: note = TNR1B Linker (23-27)
RSQHT

SEQ ID NO: 4405 - protein, 26 aa, synthetic construct
  REGION 1..26: note = TNR1B Linker (1-26)
TSTSPTRSMAPGAVHLPQPVSTRSQH

SEQ ID NO: 4406 - protein, 25 aa, synthetic construct
  REGION 1..25: note = TNR1B Linker (2-26)
STSPTRSMAPGAVHLPQPVSTRSQH

SEQ ID NO: 4407 - protein, 24 aa, synthetic construct
  REGION 1..24: note = TNR1B Linker (3-26)
TSPTRSMAPGAVHLPQPVSTRSQH

SEQ ID NO: 4408 - protein, 23 aa, synthetic construct
  REGION 1..23: note = TNR1B Linker (4-26)
SPTRSMAPGAVHLPQPVSTRSQH

SEQ ID NO: 4409 - protein, 22 aa, synthetic construct
  REGION 1..22: note = TNR1B Linker (5-26)
PTRSMAPGAVHLPQPVSTRSQH

SEQ ID NO: 4410 - protein, 21 aa, synthetic construct
  REGION 1..21: note = TNR1B Linker (6-26)
TRSMAPGAVHLPQPVSTRSQH

SEQ ID NO: 4411 - protein, 20 aa, synthetic construct
  REGION 1..20: note = TNR1B Linker (7-26)
RSMAPGAVHLPQPVSTRSQH

SEQ ID NO: 4412 - protein, 19 aa, synthetic construct
  REGION 1..19: note = TNR1B Linker (8-26)
SMAPGAVHLPQPVSTRSQH

SEQ ID NO: 4413 - protein, 18 aa, synthetic construct
  REGION 1..18: note = TNR1B Linker (9-26)
MAPGAVHLPQPVSTRSQH

SEQ ID NO: 4414 - protein, 17 aa, synthetic construct
  REGION 1..17: note = TNR1B Linker (10-26)
APGAVHLPQPVSTRSQH

SEQ ID NO: 4415 - protein, 16 aa, synthetic construct
  REGION 1..16: note = TNR1B Linker (11-26)
PGAVHLPQPVSTRSQH

SEQ ID NO: 4416 - protein, 15 aa, synthetic construct
  REGION 1..15: note = TNR1B Linker (12-26)
GAVHLPQPVSTRSQH

SEQ ID NO: 4417 - protein, 14 aa, synthetic construct
  REGION 1..14: note = TNR1B Linker (13-26)
AVHLPQPVSTRSQH

SEQ ID NO: 4418 - protein, 13 aa, synthetic construct
  REGION 1..13: note = TNR1B Linker (14-26)
VHLPQPVSTRSQH

SEQ ID NO: 4419 - protein, 12 aa, synthetic construct
  REGION 1..12: note = TNR1B Linker (15-26)
HLPQPVSTRSQH

SEQ ID NO: 4420 - protein, 11 aa, synthetic construct
  REGION 1..11: note = TNR1B Linker (16-26)
LPQPVSTRSQH

SEQ ID NO: 4421 - protein, 10 aa, synthetic construct
  REGION 1..10: note = TNR1B Linker (17-26)
PQPVSTRSQH

SEQ ID NO: 4422 - protein, 9 aa, synthetic construct
  REGION 1..9: note = TNR1B Linker (18-26)
QPVSTRSQH

SEQ ID NO: 4423 - protein, 8 aa, synthetic construct
  REGION 1..8: note = TNR1B Linker (19-26)
PVSTRSQH

SEQ ID NO: 4424 - protein, 7 aa, synthetic construct
  REGION 1..7: note = TNR1B Linker (20-26)
VSTRSQH

SEQ ID NO: 4425 - protein, 6 aa, synthetic construct
  REGION 1..6: note = TNR1B Linker (21-26)
STRSQH

SEQ ID NO: 4426 - protein, 5 aa, synthetic construct
  REGION 1..5: note = TNR1B Linker (22-26)
TRSQH

SEQ ID NO: 4427 - protein, 25 aa, synthetic construct
  REGION 1..25: note = TNR1B Linker (1-25)
TSTSPTRSMAPGAVHLPQPVSTRSQ

SEQ ID NO: 4428 - protein, 24 aa, synthetic construct
  REGION 1..24: note = TNR1B Linker (2-25)
STSPTRSMAPGAVHLPQPVSTRSQ

SEQ ID NO: 4429 - protein, 23 aa, synthetic construct
  REGION 1..23: note = TNR1B Linker (3-25)
TSPTRSMAPGAVHLPQPVSTRSQ

SEQ ID NO: 4430 - protein, 22 aa, synthetic construct
  REGION 1..22: note = TNR1B Linker (4-25)
SPTRSMAPGAVHLPQPVSTRSQ

SEQ ID NO: 4431 - protein, 21 aa, synthetic construct
  REGION 1..21: note = TNR1B Linker (5-25)
PTRSMAPGAVHLPQPVSTRSQ

SEQ ID NO: 4432 - protein, 20 aa, synthetic construct
  REGION 1..20: note = TNR1B Linker (6-25)
TRSMAPGAVHLPQPVSTRSQ

SEQ ID NO: 4433 - protein, 19 aa, synthetic construct
  REGION 1..19: note = TNR1B Linker (7-25)
RSMAPGAVHLPQPVSTRSQ

SEQ ID NO: 4434 - protein, 18 aa, synthetic construct
  REGION 1..18: note = TNR1B Linker (8-25)
SMAPGAVHLPQPVSTRSQ

SEQ ID NO: 4435 - protein, 17 aa, synthetic construct
  REGION 1..17: note = TNR1B Linker (9-25)
MAPGAVHLPQPVSTRSQ

SEQ ID NO: 4436 - protein, 16 aa, synthetic construct
  REGION 1..16: note = TNR1B Linker (10-25)
APGAVHLPQPVSTRSQ

SEQ ID NO: 4437 - protein, 15 aa, synthetic construct
  REGION 1..15: note = TNR1B Linker (11-25)
PGAVHLPQPVSTRSQ

SEQ ID NO: 4438 - protein, 14 aa, synthetic construct
  REGION 1..14: note = TNR1B Linker (12-25)
GAVHLPQPVSTRSQ

SEQ ID NO: 4439 - protein, 13 aa, synthetic construct
  REGION 1..13: note = TNR1B Linker (13-25)
AVHLPQPVSTRSQ

SEQ ID NO: 4440 - protein, 12 aa, synthetic construct
  REGION 1..12: note = TNR1B Linker (14-25)
VHLPQPVSTRSQ

SEQ ID NO: 4441 - protein, 11 aa, synthetic construct
  REGION 1..11: note = TNR1B Linker (15-25)
HLPQPVSTRSQ

SEQ ID NO: 4442 - protein, 10 aa, synthetic construct
  REGION 1..10: note = TNR1B Linker (16-25)
LPQPVSTRSQ

SEQ ID NO: 4443 - protein, 9 aa, synthetic construct
  REGION 1..9: note = TNR1B Linker (17-25)
PQPVSTRSQ

SEQ ID NO: 4444 - protein, 8 aa, synthetic construct
  REGION 1..8: note = TNR1B Linker (18-25)
QPVSTRSQ

SEQ ID NO: 4445 - protein, 7 aa, synthetic construct
  REGION 1..7: note = TNR1B Linker (19-25)
PVSTRSQ

SEQ ID NO: 4446 - protein, 6 aa, synthetic construct
  REGION 1..6: note = TNR1B Linker (20-25)
VSTRSQ

SEQ ID NO: 4447 - protein, 5 aa, synthetic construct
  REGION 1..5: note = TNR1B Linker (21-25)
STRSQ

SEQ ID NO: 4448 - protein, 24 aa, synthetic construct
  REGION 1..24: note = TNR1B Linker (1-24)
TSTSPTRSMAPGAVHLPQPVSTRS

SEQ ID NO: 4449 - protein, 23 aa, synthetic construct
  REGION 1..23: note = TNR1B Linker (2-24)
STSPTRSMAPGAVHLPQPVSTRS

SEQ ID NO: 4450 - protein, 22 aa, synthetic construct
  REGION 1..22: note = TNR1B Linker (3-24)
TSPTRSMAPGAVHLPQPVSTRS

SEQ ID NO: 4451 - protein, 21 aa, synthetic construct
  REGION 1..21: note = TNR1B Linker (4-24)
SPTRSMAPGAVHLPQPVSTRS

SEQ ID NO: 4452 - protein, 20 aa, synthetic construct
  REGION 1..20: note = TNR1B Linker (5-24)
PTRSMAPGAVHLPQPVSTRS

SEQ ID NO: 4453 - protein, 19 aa, synthetic construct
  REGION 1..19: note = TNR1B Linker (6-24)
TRSMAPGAVHLPQPVSTRS

SEQ ID NO: 4454 - protein, 18 aa, synthetic construct
  REGION 1..18: note = TNR1B Linker (7-24)
RSMAPGAVHLPQPVSTRS

SEQ ID NO: 4455 - protein, 17 aa, synthetic construct
  REGION 1..17: note = TNR1B Linker (8-24)
SMAPGAVHLPQPVSTRS

SEQ ID NO: 4456 - protein, 16 aa, synthetic construct
  REGION 1..16: note = TNR1B Linker (9-24)
MAPGAVHLPQPVSTRS

SEQ ID NO: 4457 - protein, 15 aa, synthetic construct
  REGION 1..15: note = TNR1B Linker (10-24)
APGAVHLPQPVSTRS

SEQ ID NO: 4458 - protein, 14 aa, synthetic construct
  REGION 1..14: note = TNR1B Linker (11-24)
PGAVHLPQPVSTRS

SEQ ID NO: 4459 - protein, 13 aa, synthetic construct
  REGION 1..13: note = TNR1B Linker (12-24)
GAVHLPQPVSTRS

SEQ ID NO: 4460 - protein, 12 aa, synthetic construct
  REGION 1..12: note = TNR1B Linker (13-24)
AVHLPQPVSTRS

SEQ ID NO: 4461 - protein, 11 aa, synthetic construct
  REGION 1..11: note = TNR1B Linker (14-24)
VHLPQPVSTRS

SEQ ID NO: 4462 - protein, 10 aa, synthetic construct
  REGION 1..10: note = TNR1B Linker (15-24)
HLPQPVSTRS

SEQ ID NO: 4463 - protein, 9 aa, synthetic construct
  REGION 1..9: note = TNR1B Linker (16-24)
LPQPVSTRS

SEQ ID NO: 4464 - protein, 8 aa, synthetic construct
  REGION 1..8: note = TNR1B Linker (17-24)
PQPVSTRS

SEQ ID NO: 4465 - protein, 7 aa, synthetic construct
  REGION 1..7: note = TNR1B Linker (18-24)
QPVSTRS

SEQ ID NO: 4466 - protein, 6 aa, synthetic construct
  REGION 1..6: note = TNR1B Linker (19-24)
PVSTRS

SEQ ID NO: 4467 - protein, 5 aa, synthetic construct
  REGION 1..5: note = TNR1B Linker (20-24)
VSTRS

SEQ ID NO: 4468 - protein, 23 aa, synthetic construct
  REGION 1..23: note = TNR1B Linker (1-23)
TSTSPTRSMAPGAVHLPQPVSTR

SEQ ID NO: 4469 - protein, 22 aa, synthetic construct
  REGION 1..22: note = TNR1B Linker (2-23)
STSPTRSMAPGAVHLPQPVSTR

SEQ ID NO: 4470 - protein, 21 aa, synthetic construct
  REGION 1..21: note = TNR1B Linker (3-23)
TSPTRSMAPGAVHLPQPVSTR

SEQ ID NO: 4471 - protein, 20 aa, synthetic construct
  REGION 1..20: note = TNR1B Linker (4-23)
SPTRSMAPGAVHLPQPVSTR

SEQ ID NO: 4472 - protein, 19 aa, synthetic construct
  REGION 1..19: note = TNR1B Linker (5-23)
PTRSMAPGAVHLPQPVSTR

SEQ ID NO: 4473 - protein, 18 aa, synthetic construct
  REGION 1..18: note = TNR1B Linker (6-23)
TRSMAPGAVHLPQPVSTR

SEQ ID NO: 4474 - protein, 17 aa, synthetic construct
  REGION 1..17: note = TNR1B Linker (7-23)
RSMAPGAVHLPQPVSTR

SEQ ID NO: 4475 - protein, 16 aa, synthetic construct
  REGION 1..16: note = TNR1B Linker (8-23)
SMAPGAVHLPQPVSTR

SEQ ID NO: 4476 - protein, 15 aa, synthetic construct
  REGION 1..15: note = TNR1B Linker (9-23)
MAPGAVHLPQPVSTR

SEQ ID NO: 4477 - protein, 14 aa, synthetic construct
  REGION 1..14: note = TNR1B Linker (10-23)
APGAVHLPQPVSTR

SEQ ID NO: 4478 - protein, 13 aa, synthetic construct
  REGION 1..13: note = TNR1B Linker (11-23)
PGAVHLPQPVSTR

SEQ ID NO: 4479 - protein, 12 aa, synthetic construct
  REGION 1..12: note = TNR1B Linker (12-23)
GAVHLPQPVSTR

SEQ ID NO: 4480 - protein, 11 aa, synthetic construct
  REGION 1..11: note = TNR1B Linker (13-23)
AVHLPQPVSTR

SEQ ID NO: 4481 - protein, 10 aa, synthetic construct
  REGION 1..10: note = TNR1B Linker (14-23)
VHLPQPVSTR

SEQ ID NO: 4482 - protein, 9 aa, synthetic construct
  REGION 1..9: note = TNR1B Linker (15-23)
HLPQPVSTR

SEQ ID NO: 4483 - protein, 8 aa, synthetic construct
  REGION 1..8: note = TNR1B Linker (16-23)
LPQPVSTR

SEQ ID NO: 4484 - protein, 7 aa, synthetic construct
  REGION 1..7: note = TNR1B Linker (17-23)
PQPVSTR

SEQ ID NO: 4485 - protein, 6 aa, synthetic construct
  REGION 1..6: note = TNR1B Linker (18-23)
QPVSTR

SEQ ID NO: 4486 - protein, 5 aa, synthetic construct
  REGION 1..5: note = TNR1B Linker (19-23)
PVSTR

SEQ ID NO: 4487 - protein, 22 aa, synthetic construct
  REGION 1..22: note = TNR1B Linker (1-22)
TSTSPTRSMAPGAVHLPQPVST

SEQ ID NO: 4488 - protein, 21 aa, synthetic construct
  REGION 1..21: note = TNR1B Linker (2-22)
STSPTRSMAPGAVHLPQPVST

SEQ ID NO: 4489 - protein, 20 aa, synthetic construct
  REGION 1..20: note = TNR1B Linker (3-22)
TSPTRSMAPGAVHLPQPVST

SEQ ID NO: 4490 - protein, 19 aa, synthetic construct
  REGION 1..19: note = TNR1B Linker (4-22)
SPTRSMAPGAVHLPQPVST

SEQ ID NO: 4491 - protein, 18 aa, synthetic construct
  REGION 1..18: note = TNR1B Linker (5-22)
PTRSMAPGAVHLPQPVST

SEQ ID NO: 4492 - protein, 17 aa, synthetic construct
  REGION 1..17: note = TNR1B Linker (6-22)
TRSMAPGAVHLPQPVST

SEQ ID NO: 4493 - protein, 16 aa, synthetic construct
  REGION 1..16: note = TNR1B Linker (7-22)
RSMAPGAVHLPQPVST

SEQ ID NO: 4494 - protein, 15 aa, synthetic construct
  REGION 1..15: note = TNR1B Linker (8-22)
SMAPGAVHLPQPVST

SEQ ID NO: 4495 - protein, 14 aa, synthetic construct
  REGION 1..14: note = TNR1B Linker (9-22)
MAPGAVHLPQPVST

SEQ ID NO: 4496 - protein, 13 aa, synthetic construct
  REGION 1..13: note = TNR1B Linker (10-22)
APGAVHLPQPVST

SEQ ID NO: 4497 - protein, 12 aa, synthetic construct
  REGION 1..12: note = TNR1B Linker (11-22)
PGAVHLPQPVST

SEQ ID NO: 4498 - protein, 11 aa, synthetic construct
  REGION 1..11: note = TNR1B Linker (12-22)
GAVHLPQPVST

SEQ ID NO: 4499 - protein, 10 aa, synthetic construct
  REGION 1..10: note = TNR1B Linker (13-22)
AVHLPQPVST

SEQ ID NO: 4500 - protein, 9 aa, synthetic construct
  REGION 1..9: note = TNR1B Linker (14-22)
VHLPQPVST

SEQ ID NO: 4501 - protein, 8 aa, synthetic construct
  REGION 1..8: note = TNR1B Linker (15-22)
HLPQPVST

SEQ ID NO: 4502 - protein, 7 aa, synthetic construct
  REGION 1..7: note = TNR1B Linker (16-22)
LPQPVST

SEQ ID NO: 4503 - protein, 6 aa, synthetic construct
  REGION 1..6: note = TNR1B Linker (17-22)
PQPVST

SEQ ID NO: 4504 - protein, 5 aa, synthetic construct
  REGION 1..5: note = TNR1B Linker (18-22)
QPVST

SEQ ID NO: 4505 - protein, 21 aa, synthetic construct
  REGION 1..21: note = TNR1B Linker (1-21)
TSTSPTRSMAPGAVHLPQPVS

SEQ ID NO: 4506 - protein, 20 aa, synthetic construct
  REGION 1..20: note = TNR1B Linker (2-21)
STSPTRSMAPGAVHLPQPVS

SEQ ID NO: 4507 - protein, 19 aa, synthetic construct
  REGION 1..19: note = TNR1B Linker (3-21)
TSPTRSMAPGAVHLPQPVS

SEQ ID NO: 4508 - protein, 18 aa, synthetic construct
  REGION 1..18: note = TNR1B Linker (4-21)
SPTRSMAPGAVHLPQPVS

SEQ ID NO: 4509 - protein, 17 aa, synthetic construct
  REGION 1..17: note = TNR1B Linker (5-21)
PTRSMAPGAVHLPQPVS

SEQ ID NO: 4510 - protein, 16 aa, synthetic construct
  REGION 1..16: note = TNR1B Linker (6-21)
TRSMAPGAVHLPQPVS

SEQ ID NO: 4511 - protein, 15 aa, synthetic construct
  REGION 1..15: note = TNR1B Linker (7-21)
RSMAPGAVHLPQPVS

SEQ ID NO: 4512 - protein, 14 aa, synthetic construct
  REGION 1..14: note = TNR1B Linker (8-21)
SMAPGAVHLPQPVS

SEQ ID NO: 4513 - protein, 13 aa, synthetic construct
  REGION 1..13: note = TNR1B Linker (9-21)
MAPGAVHLPQPVS

SEQ ID NO: 4514 - protein, 12 aa, synthetic construct
  REGION 1..12: note = TNR1B Linker (10-21)
APGAVHLPQPVS

SEQ ID NO: 4515 - protein, 11 aa, synthetic construct
  REGION 1..11: note = TNR1B Linker (11-21)
PGAVHLPQPVS

SEQ ID NO: 4516 - protein, 10 aa, synthetic construct
  REGION 1..10: note = TNR1B Linker (12-21)
GAVHLPQPVS

SEQ ID NO: 4517 - protein, 9 aa, synthetic construct
  REGION 1..9: note = TNR1B Linker (13-21)
AVHLPQPVS

SEQ ID NO: 4518 - protein, 8 aa, synthetic construct
  REGION 1..8: note = TNR1B Linker (14-21)
VHLPQPVS

SEQ ID NO: 4519 - protein, 7 aa, synthetic construct
  REGION 1..7: note = TNR1B Linker (15-21)
HLPQPVS

SEQ ID NO: 4520 - protein, 6 aa, synthetic construct
  REGION 1..6: note = TNR1B Linker (16-21)
LPQPVS

SEQ ID NO: 4521 - protein, 5 aa, synthetic construct
  REGION 1..5: note = TNR1B Linker (17-21)
PQPVS

SEQ ID NO: 4522 - protein, 20 aa, synthetic construct
  REGION 1..20: note = TNR1B Linker (1-20)
TSTSPTRSMAPGAVHLPQPV

SEQ ID NO: 4523 - protein, 19 aa, synthetic construct
  REGION 1..19: note = TNR1B Linker (2-20)
STSPTRSMAPGAVHLPQPV

SEQ ID NO: 4524 - protein, 18 aa, synthetic construct
  REGION 1..18: note = TNR1B Linker (3-20)
TSPTRSMAPGAVHLPQPV

SEQ ID NO: 4525 - protein, 17 aa, synthetic construct
  REGION 1..17: note = TNR1B Linker (4-20)
SPTRSMAPGAVHLPQPV

SEQ ID NO: 4526 - protein, 16 aa, synthetic construct
  REGION 1..16: note = TNR1B Linker (5-20)
PTRSMAPGAVHLPQPV

SEQ ID NO: 4527 - protein, 15 aa, synthetic construct
  REGION 1..15: note = TNR1B Linker (6-20)
TRSMAPGAVHLPQPV

SEQ ID NO: 4528 - protein, 14 aa, synthetic construct
  REGION 1..14: note = TNR1B Linker (7-20)
RSMAPGAVHLPQPV

SEQ ID NO: 4529 - protein, 13 aa, synthetic construct
  REGION 1..13: note = TNR1B Linker (8-20)
SMAPGAVHLPQPV

SEQ ID NO: 4530 - protein, 12 aa, synthetic construct
  REGION 1..12: note = TNR1B Linker (9-20)
MAPGAVHLPQPV

SEQ ID NO: 4531 - protein, 11 aa, synthetic construct
  REGION 1..11: note = TNR1B Linker (10-20)
APGAVHLPQPV

SEQ ID NO: 4532 - protein, 10 aa, synthetic construct
  REGION 1..10: note = TNR1B Linker (11-20)
PGAVHLPQPV

SEQ ID NO: 4533 - protein, 9 aa, synthetic construct
  REGION 1..9: note = TNR1B Linker (12-20)
GAVHLPQPV

SEQ ID NO: 4534 - protein, 8 aa, synthetic construct
  REGION 1..8: note = TNR1B Linker (13-20)
AVHLPQPV

SEQ ID NO: 4535 - protein, 7 aa, synthetic construct
  REGION 1..7: note = TNR1B Linker (14-20)
VHLPQPV

SEQ ID NO: 4536 - protein, 6 aa, synthetic construct
  REGION 1..6: note = TNR1B Linker (15-20)
HLPQPV

SEQ ID NO: 4537 - protein, 5 aa, synthetic construct
  REGION 1..5: note = TNR1B Linker (16-20)
LPQPV

SEQ ID NO: 4538 - protein, 19 aa, synthetic construct
  REGION 1..19: note = TNR1B Linker (1-19)
TSTSPTRSMAPGAVHLPQP

SEQ ID NO: 4539 - protein, 18 aa, synthetic construct
  REGION 1..18: note = TNR1B Linker (2-19)
STSPTRSMAPGAVHLPQP

SEQ ID NO: 4540 - protein, 17 aa, synthetic construct
  REGION 1..17: note = TNR1B Linker (3-19)
TSPTRSMAPGAVHLPQP

SEQ ID NO: 4541 - protein, 16 aa, synthetic construct
  REGION 1..16: note = TNR1B Linker (4-19)
SPTRSMAPGAVHLPQP

SEQ ID NO: 4542 - protein, 15 aa, synthetic construct
  REGION 1..15: note = TNR1B Linker (5-19)
PTRSMAPGAVHLPQP

SEQ ID NO: 4543 - protein, 14 aa, synthetic construct
  REGION 1..14: note = TNR1B Linker (6-19)
TRSMAPGAVHLPQP

SEQ ID NO: 4544 - protein, 13 aa, synthetic construct
  REGION 1..13: note = TNR1B Linker (7-19)
RSMAPGAVHLPQP

SEQ ID NO: 4545 - protein, 12 aa, synthetic construct
  REGION 1..12: note = TNR1B Linker (8-19)
SMAPGAVHLPQP

SEQ ID NO: 4546 - protein, 11 aa, synthetic construct
  REGION 1..11: note = TNR1B Linker (9-19)
MAPGAVHLPQP

SEQ ID NO: 4547 - protein, 10 aa, synthetic construct
  REGION 1..10: note = TNR1B Linker (10-19)
APGAVHLPQP

SEQ ID NO: 4548 - protein, 9 aa, synthetic construct
  REGION 1..9: note = TNR1B Linker (11-19)
PGAVHLPQP

SEQ ID NO: 4549 - protein, 8 aa, synthetic construct
  REGION 1..8: note = TNR1B Linker (12-19)
GAVHLPQP

SEQ ID NO: 4550 - protein, 7 aa, synthetic construct
  REGION 1..7: note = TNR1B Linker (13-19)
AVHLPQP

SEQ ID NO: 4551 - protein, 6 aa, synthetic construct
  REGION 1..6: note = TNR1B Linker (14-19)
VHLPQP

SEQ ID NO: 4552 - protein, 5 aa, synthetic construct
  REGION 1..5: note = TNR1B Linker (15-19)
HLPQP

SEQ ID NO: 4553 - protein, 18 aa, synthetic construct
  REGION 1..18: note = TNR1B Linker (1-18)
TSTSPTRSMAPGAVHLPQ

SEQ ID NO: 4554 - protein, 17 aa, synthetic construct
  REGION 1..17: note = TNR1B Linker (2-18)
STSPTRSMAPGAVHLPQ

SEQ ID NO: 4555 - protein, 16 aa, synthetic construct
  REGION 1..16: note = TNR1B Linker (3-18)
TSPTRSMAPGAVHLPQ

SEQ ID NO: 4556 - protein, 15 aa, synthetic construct
  REGION 1..15: note = TNR1B Linker (4-18)
SPTRSMAPGAVHLPQ

SEQ ID NO: 4557 - protein, 14 aa, synthetic construct
  REGION 1..14: note = TNR1B Linker (5-18)
PTRSMAPGAVHLPQ

SEQ ID NO: 4558 - protein, 13 aa, synthetic construct
  REGION 1..13: note = TNR1B Linker (6-18)
TRSMAPGAVHLPQ

SEQ ID NO: 4559 - protein, 12 aa, synthetic construct
  REGION 1..12: note = TNR1B Linker (7-18)
RSMAPGAVHLPQ

SEQ ID NO: 4560 - protein, 11 aa, synthetic construct
  REGION 1..11: note = TNR1B Linker (8-18)
SMAPGAVHLPQ

SEQ ID NO: 4561 - protein, 10 aa, synthetic construct
  REGION 1..10: note = TNR1B Linker (9-18)
MAPGAVHLPQ

SEQ ID NO: 4562 - protein, 9 aa, synthetic construct
  REGION 1..9: note = TNR1B Linker (10-18)
APGAVHLPQ

SEQ ID NO: 4563 - protein, 8 aa, synthetic construct
  REGION 1..8: note = TNR1B Linker (11-18)
PGAVHLPQ

SEQ ID NO: 4564 - protein, 7 aa, synthetic construct
  REGION 1..7: note = TNR1B Linker (12-18)
GAVHLPQ

SEQ ID NO: 4565 - protein, 6 aa, synthetic construct
  REGION 1..6: note = TNR1B Linker (13-18)
AVHLPQ

SEQ ID NO: 4566 - protein, 5 aa, synthetic construct
  REGION 1..5: note = TNR1B Linker (14-18)
VHLPQ

SEQ ID NO: 4567 - protein, 17 aa, synthetic construct
  REGION 1..17: note = TNR1B Linker (1-17)
TSTSPTRSMAPGAVHLP

SEQ ID NO: 4568 - protein, 16 aa, synthetic construct
  REGION 1..16: note = TNR1B Linker (2-17)
STSPTRSMAPGAVHLP

SEQ ID NO: 4569 - protein, 15 aa, synthetic construct
  REGION 1..15: note = TNR1B Linker (3-17)
TSPTRSMAPGAVHLP

SEQ ID NO: 4570 - protein, 14 aa, synthetic construct
  REGION 1..14: note = TNR1B Linker (4-17)
SPTRSMAPGAVHLP

SEQ ID NO: 4571 - protein, 13 aa, synthetic construct
  REGION 1..13: note = TNR1B Linker (5-17)
PTRSMAPGAVHLP

SEQ ID NO: 4572 - protein, 12 aa, synthetic construct
  REGION 1..12: note = TNR1B Linker (6-17)
TRSMAPGAVHLP

SEQ ID NO: 4573 - protein, 11 aa, synthetic construct
  REGION 1..11: note = TNR1B Linker (7-17)
RSMAPGAVHLP

SEQ ID NO: 4574 - protein, 10 aa, synthetic construct
  REGION 1..10: note = TNR1B Linker (8-17)
SMAPGAVHLP

SEQ ID NO: 4575 - protein, 9 aa, synthetic construct
  REGION 1..9: note = TNR1B Linker (9-17)
MAPGAVHLP

SEQ ID NO: 4576 - protein, 8 aa, synthetic construct
  REGION 1..8: note = TNR1B Linker (10-17)
APGAVHLP

SEQ ID NO: 4577 - protein, 7 aa, synthetic construct
  REGION 1..7: note = TNR1B Linker (11-17)
PGAVHLP

SEQ ID NO: 4578 - protein, 6 aa, synthetic construct
  REGION 1..6: note = TNR1B Linker (12-17)
GAVHLP

SEQ ID NO: 4579 - protein, 5 aa, synthetic construct
  REGION 1..5: note = TNR1B Linker (13-17)
AVHLP

SEQ ID NO: 4580 - protein, 16 aa, synthetic construct
  REGION 1..16: note = TNR1B Linker (1-16)
TSTSPTRSMAPGAVHL

SEQ ID NO: 4581 - protein, 15 aa, synthetic construct
  REGION 1..15: note = TNR1B Linker (2-16)
STSPTRSMAPGAVHL

SEQ ID NO: 4582 - protein, 14 aa, synthetic construct
  REGION 1..14: note = TNR1B Linker (3-16)
TSPTRSMAPGAVHL

SEQ ID NO: 4583 - protein, 13 aa, synthetic construct
  REGION 1..13: note = TNR1B Linker (4-16)
SPTRSMAPGAVHL

SEQ ID NO: 4584 - protein, 12 aa, synthetic construct
  REGION 1..12: note = TNR1B Linker (5-16)
PTRSMAPGAVHL

SEQ ID NO: 4585 - protein, 11 aa, synthetic construct
  REGION 1..11: note = TNR1B Linker (6-16)
TRSMAPGAVHL

SEQ ID NO: 4586 - protein, 10 aa, synthetic construct
  REGION 1..10: note = TNR1B Linker (7-16)
RSMAPGAVHL

SEQ ID NO: 4587 - protein, 9 aa, synthetic construct
  REGION 1..9: note = TNR1B Linker (8-16)
SMAPGAVHL

SEQ ID NO: 4588 - protein, 8 aa, synthetic construct
  REGION 1..8: note = TNR1B Linker (9-16)
MAPGAVHL

SEQ ID NO: 4589 - protein, 7 aa, synthetic construct
  REGION 1..7: note = TNR1B Linker (10-16)
APGAVHL

SEQ ID NO: 4590 - protein, 6 aa, synthetic construct
  REGION 1..6: note = TNR1B Linker (11-16)
PGAVHL

SEQ ID NO: 4591 - protein, 5 aa, synthetic construct
  REGION 1..5: note = TNR1B Linker (12-16)
GAVHL

SEQ ID NO: 4592 - protein, 15 aa, synthetic construct
  REGION 1..15: note = TNR1B Linker (1-15)
TSTSPTRSMAPGAVH

SEQ ID NO: 4593 - protein, 14 aa, synthetic construct
  REGION 1..14: note = TNR1B Linker (2-15)
STSPTRSMAPGAVH

SEQ ID NO: 4594 - protein, 13 aa, synthetic construct
  REGION 1..13: note = TNR1B Linker (3-15)
TSPTRSMAPGAVH

SEQ ID NO: 4595 - protein, 12 aa, synthetic construct
  REGION 1..12: note = TNR1B Linker (4-15)
SPTRSMAPGAVH

SEQ ID NO: 4596 - protein, 11 aa, synthetic construct
  REGION 1..11: note = TNR1B Linker (5-15)
PTRSMAPGAVH

SEQ ID NO: 4597 - protein, 10 aa, synthetic construct
  REGION 1..10: note = TNR1B Linker (6-15)
TRSMAPGAVH

SEQ ID NO: 4598 - protein, 9 aa, synthetic construct
  REGION 1..9: note = TNR1B Linker (7-15)
RSMAPGAVH

SEQ ID NO: 4599 - protein, 8 aa, synthetic construct
  REGION 1..8: note = TNR1B Linker (8-15)
SMAPGAVH

SEQ ID NO: 4600 - protein, 7 aa, synthetic construct
  REGION 1..7: note = TNR1B Linker (9-15)
MAPGAVH

SEQ ID NO: 4601 - protein, 6 aa, synthetic construct
  REGION 1..6: note = TNR1B Linker (10-15)
APGAVH

SEQ ID NO: 4602 - protein, 5 aa, synthetic construct
  REGION 1..5: note = TNR1B Linker (11-15)
PGAVH

SEQ ID NO: 4603 - protein, 14 aa, synthetic construct
  REGION 1..14: note = TNR1B Linker (1-14)
TSTSPTRSMAPGAV

SEQ ID NO: 4604 - protein, 13 aa, synthetic construct
  REGION 1..13: note = TNR1B Linker (2-14)
STSPTRSMAPGAV

SEQ ID NO: 4605 - protein, 12 aa, synthetic construct
  REGION 1..12: note = TNR1B Linker (3-14)
TSPTRSMAPGAV

SEQ ID NO: 4606 - protein, 11 aa, synthetic construct
  REGION 1..11: note = TNR1B Linker (4-14)
SPTRSMAPGAV

SEQ ID NO: 4607 - protein, 10 aa, synthetic construct
  REGION 1..10: note = TNR1B Linker (5-14)
PTRSMAPGAV

SEQ ID NO: 4608 - protein, 9 aa, synthetic construct
  REGION 1..9: note = TNR1B Linker (6-14)
TRSMAPGAV

SEQ ID NO: 4609 - protein, 8 aa, synthetic construct
  REGION 1..8: note = TNR1B Linker (7-14)
RSMAPGAV

SEQ ID NO: 4610 - protein, 7 aa, synthetic construct
  REGION 1..7: note = TNR1B Linker (8-14)
SMAPGAV

SEQ ID NO: 4611 - protein, 6 aa, synthetic construct
  REGION 1..6: note = TNR1B Linker (9-14)
MAPGAV

SEQ ID NO: 4612 - protein, 5 aa, synthetic construct
  REGION 1..5: note = TNR1B Linker (10-14)
APGAV

SEQ ID NO: 4613 - protein, 13 aa, synthetic construct
  REGION 1..13: note = TNR1B Linker (1-13)
TSTSPTRSMAPGA

SEQ ID NO: 4614 - protein, 12 aa, synthetic construct
  REGION 1..12: note = TNR1B Linker (2-13)
STSPTRSMAPGA

SEQ ID NO: 4615 - protein, 11 aa, synthetic construct
  REGION 1..11: note = TNR1B Linker (3-13)
TSPTRSMAPGA

SEQ ID NO: 4616 - protein, 10 aa, synthetic construct
  REGION 1..10: note = TNR1B Linker (4-13)
SPTRSMAPGA

SEQ ID NO: 4617 - protein, 9 aa, synthetic construct
  REGION 1..9: note = TNR1B Linker (5-13)
PTRSMAPGA

SEQ ID NO: 4618 - protein, 8 aa, synthetic construct
  REGION 1..8: note = TNR1B Linker (6-13)
TRSMAPGA

SEQ ID NO: 4619 - protein, 7 aa, synthetic construct
  REGION 1..7: note = TNR1B Linker (7-13)
RSMAPGA

SEQ ID NO: 4620 - protein, 6 aa, synthetic construct
  REGION 1..6: note = TNR1B Linker (8-13)
SMAPGA

SEQ ID NO: 4621 - protein, 5 aa, synthetic construct
  REGION 1..5: note = TNR1B Linker (9-13)
MAPGA

SEQ ID NO: 4622 - protein, 12 aa, synthetic construct
  REGION 1..12: note = TNR1B Linker (1-12)
TSTSPTRSMAPG

SEQ ID NO: 4623 - protein, 11 aa, synthetic construct
  REGION 1..11: note = TNR1B Linker (2-12)
STSPTRSMAPG

SEQ ID NO: 4624 - protein, 10 aa, synthetic construct
  REGION 1..10: note = TNR1B Linker (3-12)
TSPTRSMAPG

SEQ ID NO: 4625 - protein, 9 aa, synthetic construct
  REGION 1..9: note = TNR1B Linker (4-12)
SPTRSMAPG

SEQ ID NO: 4626 - protein, 8 aa, synthetic construct
  REGION 1..8: note = TNR1B Linker (5-12)
PTRSMAPG

SEQ ID NO: 4627 - protein, 7 aa, synthetic construct
  REGION 1..7: note = TNR1B Linker (6-12)
TRSMAPG

SEQ ID NO: 4628 - protein, 6 aa, synthetic construct
  REGION 1..6: note = TNR1B Linker (7-12)
RSMAPG

SEQ ID NO: 4629 - protein, 5 aa, synthetic construct
  REGION 1..5: note = TNR1B Linker (8-12)
SMAPG

SEQ ID NO: 4630 - protein, 11 aa, synthetic construct
  REGION 1..11: note = TNR1B Linker (1-11)
TSTSPTRSMAP

SEQ ID NO: 4631 - protein, 10 aa, synthetic construct
  REGION 1..10: note = TNR1B Linker (2-11)
STSPTRSMAP

SEQ ID NO: 4632 - protein, 9 aa, synthetic construct
  REGION 1..9: note = TNR1B Linker (3-11)
TSPTRSMAP

SEQ ID NO: 4633 - protein, 8 aa, synthetic construct
  REGION 1..8: note = TNR1B Linker (4-11)
SPTRSMAP

SEQ ID NO: 4634 - protein, 7 aa, synthetic construct
  REGION 1..7: note = TNR1B Linker (5-11)
PTRSMAP

SEQ ID NO: 4635 - protein, 6 aa, synthetic construct
  REGION 1..6: note = TNR1B Linker (6-11)
TRSMAP

SEQ ID NO: 4636 - protein, 5 aa, synthetic construct
  REGION 1..5: note = TNR1B Linker (7-11)
RSMAP

SEQ ID NO: 4637 - protein, 10 aa, synthetic construct
  REGION 1..10: note = TNR1B Linker (1-10)
TSTSPTRSMA

SEQ ID NO: 4638 - protein, 9 aa, synthetic construct
  REGION 1..9: note = TNR1B Linker (2-10)
STSPTRSMA

SEQ ID NO: 4639 - protein, 8 aa, synthetic construct
  REGION 1..8: note = TNR1B Linker (3-10)
TSPTRSMA

SEQ ID NO: 4640 - protein, 7 aa, synthetic construct
  REGION 1..7: note = TNR1B Linker (4-10)
SPTRSMA

SEQ ID NO: 4641 - protein, 6 aa, synthetic construct
  REGION 1..6: note = TNR1B Linker (5-10)
PTRSMA

SEQ ID NO: 4642 - protein, 5 aa, synthetic construct
  REGION 1..5: note = TNR1B Linker (6-10)
TRSMA

SEQ ID NO: 4643 - protein, 9 aa, synthetic construct
  REGION 1..9: note = TNR1B Linker (1-9)
TSTSPTRSM

SEQ ID NO: 4644 - protein, 8 aa, synthetic construct
  REGION 1..8: note = TNR1B Linker (2-9)
STSPTRSM

SEQ ID NO: 4645 - protein, 7 aa, synthetic construct
  REGION 1..7: note = TNR1B Linker (3-9)
TSPTRSM

SEQ ID NO: 4646 - protein, 6 aa, synthetic construct
  REGION 1..6: note = TNR1B Linker (4-9)
SPTRSM

SEQ ID NO: 4647 - protein, 5 aa, synthetic construct
  REGION 1..5: note = TNR1B Linker (5-9)
PTRSM

SEQ ID NO: 4648 - protein, 8 aa, synthetic construct
  REGION 1..8: note = TNR1B Linker (1-8)
TSTSPTRS

SEQ ID NO: 4649 - protein, 7 aa, synthetic construct
  REGION 1..7: note = TNR1B Linker (2-8)
STSPTRS

SEQ ID NO: 4650 - protein, 6 aa, synthetic construct
  REGION 1..6: note = TNR1B Linker (3-8)
TSPTRS

SEQ ID NO: 4651 - protein, 5 aa, synthetic construct
  REGION 1..5: note = TNR1B Linker (4-8)
SPTRS

SEQ ID NO: 4652 - protein, 7 aa, synthetic construct
  REGION 1..7: note = TNR1B Linker (1-7)
TSTSPTR

SEQ ID NO: 4653 - protein, 6 aa, synthetic construct
  REGION 1..6: note = TNR1B Linker (2-7)
STSPTR

SEQ ID NO: 4654 - protein, 5 aa, synthetic construct
  REGION 1..5: note = TNR1B Linker (3-7)
TSPTR

SEQ ID NO: 4655 - protein, 6 aa, synthetic construct
  REGION 1..6: note = TNR1B Linker (1-6)
TSTSPT

SEQ ID NO: 4656 - protein, 5 aa, synthetic construct
  REGION 1..5: note = TNR1B Linker (2-6)
STSPT

SEQ ID NO: 4657 - protein, 31 aa, synthetic construct; identical to SEQ ID NO: 321
  REGION 1..31: note = GLP-1 peptide

SEQ ID NO: 4658 - protein, 606 aa, synthetic construct; identical to SEQ ID NO: 723
  REGION 1..606: note = R_VH-CH1/K147E/K213E/CLD201/hole/PGLALA/RF

SEQ ID NO: 4659 - protein, 440 aa, synthetic construct; identical to SEQ ID NO: 660
  REGION 1..440: note = Sp34_VK-CH1/knob/PGLALA/RF

SEQ ID NO: 4660 - protein, 606 aa, synthetic construct; identical to SEQ ID NO: 725
  REGION 1..606: note = R_VH-CH1/Q39K/S183E/CLD201/hole/PGLALA/RF

SEQ ID NO: 4661 - protein, 440 aa, synthetic construct; identical to SEQ ID NO: 661
  REGION 1..440: note = Sp34_VK-CH1/knob/Q38E/S183K/PGLALA/RF

SEQ ID NO: 4662 - protein, 440 aa, synthetic construct; identical to SEQ ID NO: 662
  REGION 1..440: note = Sp34_VK-CH1/knob/Q38K/S183K/PGLALA/RF

SEQ ID NO: 4663 - protein, 450 aa, synthetic construct
  REGION 1..450: note = R_VH-CH1/K147E/K213E/knob/PGLALA
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4664 - protein, 450 aa, synthetic construct
  REGION 1..450: note = R_VH-CH1/Q39K/S183E/knob/PGLALA
QVQLQQPGAELVKPGASVKMSCKASGYTFTSYNMHWVKKTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4665 - protein, 594 aa, synthetic construct
  REGION 1..594: note = R_VH-CH1/K147E/K213E/CLD201/Sp34_VK-CH1
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRQAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4666 - protein, 594 aa, synthetic construct
  REGION 1..594: note = R_VH-CH1/Q39K/S183E/CLD201/Sp34_VK-CH1/Q38E/S183K
QVQLQQPGAELVKPGASVKMSCKASGYTFTSYNMHWVKKTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRQAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSC

SEQ ID NO: 4667 - protein, 594 aa, synthetic construct
  REGION 1..594: note = R_VH-CH1/Q39K/S183E/CLD201/Sp34_VK-CH1/Q38K/S183K
QVQLQQPGAELVKPGASVKMSCKASGYTFTSYNMHWVKKTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRQAVVTQEPSLTVSPGGTVTLTCGSSTGAVTTSNYANWVQKKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSC

SEQ ID NO: 4668 - protein, 605 aa, synthetic construct; identical to SEQ ID NO: 728
  REGION 1..605: note = FMC63_VH-CH1/N84S/K147E/K213E/CLD201/hole/PGLALA/RF

SEQ ID NO: 4669 - protein, 605 aa, synthetic construct; identical to SEQ ID NO: 730
  REGION 1..605: note = FMC63_VH-CH1/N84S/Q39K/S183E/CLD201/hole/PGLALA/RF

SEQ ID NO: 4670 - protein, 449 aa, synthetic construct
  REGION 1..449: note = FMC63_VH-CH1/N84S/K147E/K213E/knob/PGLALA
EVKLQESGPGLVAPSQSLSVTCTVSGVSLPDYGVSWIRQPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4671 - protein, 449 aa, synthetic construct
  REGION 1..449: note = FMC63_VH-CH1/N84S/Q39K/S183E/knob/PGLALA
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4672 - protein, 593 aa, synthetic construct
  REGION 1..593: note = FMC63_VH-CH1/N84S/K147E/K213E/CLD201/Sp34_VK-CH1
EVKLQESGPGLVAPSQSLSVTCTVSGVSLPDYGVSWIRQPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRQAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4673 - protein, 593 aa, synthetic construct
  REGION 1..593: note FMC63_VH-CH1/N84S/Q39K/S183E/CLD201/Sp34_VK-CH1/Q38E/S183K
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRQAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSC

SEQ ID NO: 4674 - protein, 593 aa, synthetic construct
  REGION 1..593: note FMC63_VH-CH1/N84S/Q39K/S183E/CLD201/Sp34_VK-CH1/Q38K/S183K
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRQAVVTQEPSLTVSPGGTVTLTCGSSTGAVTTSNYANWVQKKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSC

SEQ ID NO: 4675 - protein, 604 aa, synthetic construct
  REGION 1..604: note = Ob_VH-CH1/K147E/K213E/CLD201/hole/PGLALA/RF
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4676 - protein, 604 aa, synthetic construct
  REGION 1..604: note = Ob_VH-CH1/Q39K/S183E/CLD201/hole/PGLALA/RF
QVQLVQSGAEVKKPGSSVKVSCKASGYAFSYSWINWVRKAPGQGLEWMGRIFPGDGDTDYNGKFKGRVTITADKSTSTAYMELSSLRSEDTAVYYCARNVFDGYWLVYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4677 - protein, 448 aa, synthetic construct
  REGION 1..448: note = Ob_VH-CH1/K147E/K213E/knob/PGLALA
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4678 - protein, 448 aa, synthetic construct
  REGION 1..448: note = Ob_VH-CH1/Q39K/S183E/knob/PGLALA
QVQLVQSGAEVKKPGSSVKVSCKASGYAFSYSWINWVRKAPGQGLEWMGRIFPGDGDTDYNGKFKGRVTITADKSTSTAYMELSSLRSEDTAVYYCARNVFDGYWLVYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4679 - protein, 592 aa, synthetic construct
  REGION 1..592: note = Ob_VH-CH1/K147E/K213E/CLD201/Sp34_VK-CH1
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRQAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4680 - protein, 592 aa, synthetic construct
  REGION 1..592: note = Ob_VH-CH1/Q39K/S183E/CLD201/Sp34_VK-CH1/Q38E/S183K
QVQLVQSGAEVKKPGSSVKVSCKASGYAFSYSWINWVRKAPGQGLEWMGRIFPGDGDTDYNGKFKGRVTITADKSTSTAYMELSSLRSEDTAVYYCARNVFDGYWLVYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRQAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSC

SEQ ID NO: 4681 - protein, 592 aa, synthetic construct
  REGION 1..592: note = Ob_VH-CH1/Q39K/S183E/CLD201/Sp34_VK-CH1/Q38K/S183K
QVQLVQSGAEVKKPGSSVKVSCKASGYAFSYSWINWVRKAPGQGLEWMGRIFPGDGDTDYNGKFKGRVTITADKSTSTAYMELSSLRSEDTAVYYCARNVFDGYWLVYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRQAVVTQEPSLTVSPGGTVTLTCGSSTGAVTTSNYANWVQKKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSC

SEQ ID NO: 4682 - protein, 459 aa, synthetic construct
  REGION 1..459: note = Sp34_VK-CH1/knob/PGLALA
MEWSWVFLFFLSVTTGVHSQAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4683 - protein, 459 aa, synthetic construct
  REGION 1..459: note = Sp34_VK-CH1/knob/Q38E/S183K/PGLALA
MEWSWVFLFFLSVTTGVHSQAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4684 - protein, 459 aa, synthetic construct
  REGION 1..459: note = Sp34_VK-CH1/knob/Q38K/S183K/PGLALA
MEWSWVFLFFLSVTTGVHSQAVVTQEPSLTVSPGGTVTLTCGSSTGAVTTSNYANWVQKKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4685 - protein, 213 aa, synthetic construct; identical to SEQ ID NO: 733
  REGION 1..213: note = R_VK-CK/E123R/Q124K

SEQ ID NO: 4686 - protein, 232 aa, synthetic construct; identical to SEQ ID NO: 697
  REGION 1..232: note = Sp34_VH-CK/N84S

SEQ ID NO: 4687 - protein, 213 aa, synthetic construct; identical to SEQ ID NO: 735
  REGION 1..213: note = R_VK-CK/Q38E/V133K

SEQ ID NO: 4688 - protein, 232 aa, synthetic construct; identical to SEQ ID NO: 698
  REGION 1..232: note = Sp34_VH-CK/N84S/Q39K/V133E

SEQ ID NO: 4689 - protein, 232 aa, synthetic construct; identical to SEQ ID NO: 699
  REGION 1..232: note = Sp34_VH-CK/N84S/Q39E/V133E

SEQ ID NO: 4690 - protein, 214 aa, synthetic construct; identical to SEQ ID NO: 738
  REGION 1..214: note = FMC63_VK-CK/E123R/Q124K

SEQ ID NO: 4691 - protein, 214 aa, synthetic construct; identical to SEQ ID NO: 740
  REGION 1..214: note = FMC63_VK-CK/Q38E/V133K

SEQ ID NO: 4692 - protein, 219 aa, synthetic construct; identical to SEQ ID NO: 38
  REGION 1..219: note = Ob_VK-CK/E123R/Q124K

SEQ ID NO: 4693 - protein, 219 aa, synthetic construct
  REGION 1..219: note = Ob_VK-CK/Q38E/V133K
DIVMTQTPLSLPVTPGEPASISCRSSKSLLHSNGITYLYWYLEKPGQSPQLLIYQMSNLVSGVPDRFSGSGSGTDFTLKISRVEAEDVGVYYCAQNLELPYTFGGGTKVEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 4694 - protein, 221 aa, synthetic construct; identical to SEQ ID NO: 706
  REGION 1..221: note = Fc6/knob/PGLALA

SEQ ID NO: 4695 - protein, 606 aa, synthetic construct; identical to SEQ ID NO: 709
  REGION 1..606: note = R_VH-CH1/Q39K/S183E/CLD201/hole/RF

SEQ ID NO: 4696 - protein, 438 aa, synthetic construct; identical to SEQ ID NO: 710
  REGION 1..438: note = FMC63_VK-x-CH1/Q38E/S183K/knob

SEQ ID NO: 4697 - protein, 438 aa, synthetic construct; identical to SEQ ID NO: 711
  REGION 1..438: note = FMC63_VK-x-CH1/Q38K/S183K/knob

SEQ ID NO: 4698 - protein, 605 aa, synthetic construct; identical to SEQ ID NO: 714
  REGION 1..605: note = FMC63_VH-CH1/N84S/Q39K/S183E/CLD201/hole/RF

SEQ ID NO: 4699 - protein, 437 aa, synthetic construct; identical to SEQ ID NO: 715
  REGION 1..437: note = R_VK-x-CH1/Q38E/S183K/knob

SEQ ID NO: 4700 - protein, 437 aa, synthetic construct; identical to SEQ ID NO: 716
  REGION 1..437: note = R_VK-x-CH1/Q38K/S183K/knob

SEQ ID NO: 4701 - protein, 606 aa, synthetic construct
  REGION 1..606: note = R_VH-CH1/K147E/K213E/CLD201/hole/SSDA/RF
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPDVFLFPPKPKDTLMISRTPEVTCVVVDVSHEDPEVKFNWYVDGVEVHNAKTKPREEQYNATYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4702 - protein, 438 aa, synthetic construct
  REGION 1..438: note = FMC63_VK-x-CH1/knob/AILE
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4703 - protein, 606 aa, synthetic construct
  REGION 1..606: note = R_VH-CH1/Q39K/S183E/CLD201/hole/SSDA/RF
QVQLQQPGAELVKPGASVKMSCKASGYTFTSYNMHWVKKTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPDVFLFPPKPKDTLMISRTPEVTCVVVDVSHEDPEVKFNWYVDGVEVHNAKTKPREEQYNATYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4704 - protein, 438 aa, synthetic construct
  REGION 1..438: note = FMC63_VK-x-CH1/Q38E/S183K/knob/AILE
DIQMTQTTSSLSASLGDRVTISCRASQDISKYLNWYQEKPDGTVKLLIYHTSRLHSGVPSRFSGSGSGTDYSLTISNLEQEDIATYFCQQGNTLPYTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4705 - protein, 438 aa, synthetic construct
  REGION 1..438: note = FMC63_VK-x-CH1/Q38K/S183K/knob/AILE
DIQMTQTTSSLSASLGDRVTISCRASQDISKYLNWYQKKPDGTVKLLIYHTSRLHSGVPSRFSGSGSGTDYSLTISNLEQEDIATYFCQQGNTLPYTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4706 - protein, 605 aa, synthetic construct
  REGION 1..605: note = FMC63_VH-CH1/N84S/K147E/K213E/CLD201/hole/SSDA/RF
EVKLQESGPGLVAPSQSLSVTCTVSGVSLPDYGVSWIRQPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPDVFLFPPKPKDTLMISRTPEVTCVVVDVSHEDPEVKFNWYVDGVEVHNAKTKPREEQYNATYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4707 - protein, 437 aa, synthetic construct
  REGION 1..437: note = R_VK-x-CH1/knob/AILE
QIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4708 - protein, 605 aa, synthetic construct
  REGION 1..605: note = FMC63_VH-CH1/N84S/Q39K/S183E/CLD201/hole/SSDA/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPDVFLFPPKPKDTLMISRTPEVTCVVVDVSHEDPEVKFNWYVDGVEVHNAKTKPREEQYNATYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4709 - protein, 437 aa, synthetic construct
  REGION 1..437: note = R_VK-x-CH1/Q38E/S183K/knob/AILE
QIVLSQSPAILSASPGEKVTMTCRASSSVSYIHWFQEKPGSSPKPWIYATSNLASGVPVRFSGSGSGTSYSLTISRVEAEDAATYYCQQWTSNPPTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4710 - protein, 437 aa, synthetic construct
  REGION 1..437: note = R_VK-x-CH1/Q38K/S183K/knob/AILE
QIVLSQSPAILSASPGEKVTMTCRASSSVSYIHWFQKKPGSSPKPWIYATSNLASGVPVRFSGSGSGTSYSLTISRVEAEDAATYYCQQWTSNPPTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4711 - protein, 606 aa, synthetic construct
  REGION 1..606: note = R_VH-CH1/K147E/K213E/CLD201/hole/AILE/RF
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4712 - protein, 438 aa, synthetic construct
  REGION 1..438: note = FMC63_VK-x-CH1/knob/SSDA
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNATYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4713 - protein, 606 aa, synthetic construct
  REGION 1..606: note = R_VH-CH1/Q39K/S183E/CLD201/hole/AILE/RF
QVQLQQPGAELVKPGASVKMSCKASGYTFTSYNMHWVKKTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4714 - protein, 438 aa, synthetic construct
  REGION 1..438: note = FMC63_VK-x-CH1/Q38E/S183K/knob/SSDA
DIQMTQTTSSLSASLGDRVTISCRASQDISKYLNWYQEKPDGTVKLLIYHTSRLHSGVPSRFSGSGSGTDYSLTISNLEQEDIATYFCQQGNTLPYTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNATYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4715 - protein, 438 aa, synthetic construct
  REGION 1..438: note = FMC63_VK-x-CH1/Q38K/S183K/knob/SSDA
DIQMTQTTSSLSASLGDRVTISCRASQDISKYLNWYQKKPDGTVKLLIYHTSRLHSGVPSRFSGSGSGTDYSLTISNLEQEDIATYFCQQGNTLPYTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNATYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4716 - protein, 605 aa, synthetic construct
  REGION 1..605: note = FMC63_VH-CH1/N84S/K147E/K213E/CLD201/hole/AILE/RF
EVKLQESGPGLVAPSQSLSVTCTVSGVSLPDYGVSWIRQPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4717 - protein, 437 aa, synthetic construct
  REGION 1..437: note = R_VK-x-CH1/knob/SSDA
QIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNATYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4718 - protein, 605 aa, synthetic construct
  REGION 1..605: note = FMC63_VH-CH1/N84S/Q39K/S183E/CLD201/hole/AILE/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4719 - protein, 437 aa, synthetic construct
  REGION 1..437: note = R_VK-x-CH1/Q38E/S183K/knob/SSDA
QIVLSQSPAILSASPGEKVTMTCRASSSVSYIHWFQEKPGSSPKPWIYATSNLASGVPVRFSGSGSGTSYSLTISRVEAEDAATYYCQQWTSNPPTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNATYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4720 - protein, 437 aa, synthetic construct
  REGION 1..437: note = R_VK-x-CH1/Q38K/S183K/knob/SSDA
QIVLSQSPAILSASPGEKVTMTCRASSSVSYIHWFQKKPGSSPKPWIYATSNLASGVPVRFSGSGSGTSYSLTISRVEAEDAATYYCQQWTSNPPTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNATYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4721 - protein, 606 aa, synthetic construct
  REGION 1..606: note = R_VH-CH1/K147E/K213E/CLD201/hole/SIDE/RF
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4722 - protein, 438 aa, synthetic construct
  REGION 1..438: note = FMC63_VK-x-CH1/knob/SIDE
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4723 - protein, 606 aa, synthetic construct
  REGION 1..606: note = R_VH-CH1/Q39K/S183E/CLD201/hole/SIDE/RF
QVQLQQPGAELVKPGASVKMSCKASGYTFTSYNMHWVKKTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4724 - protein, 438 aa, synthetic construct
  REGION 1..438: note = FMC63_VK-x-CH1/Q38E/S183K/knob/SIDE
DIQMTQTTSSLSASLGDRVTISCRASQDISKYLNWYQEKPDGTVKLLIYHTSRLHSGVPSRFSGSGSGTDYSLTISNLEQEDIATYFCQQGNTLPYTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4725 - protein, 438 aa, synthetic construct
  REGION 1..438: note = FMC63_VK-x-CH1/Q38K/S183K/knob/SIDE
DIQMTQTTSSLSASLGDRVTISCRASQDISKYLNWYQKKPDGTVKLLIYHTSRLHSGVPSRFSGSGSGTDYSLTISNLEQEDIATYFCQQGNTLPYTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4726 - protein, 605 aa, synthetic construct
  REGION 1..605: note = FMC63_VH-CH1/N84S/K147E/K213E/CLD201/hole/SIDE/RF
EVKLQESGPGLVAPSQSLSVTCTVSGVSLPDYGVSWIRQPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4727 - protein, 437 aa, synthetic construct
  REGION 1..437: note = R_VK-x-CH1/knob/SIDE
QIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4728 - protein, 605 aa, synthetic construct
  REGION 1..605: note = FMC63_VH-CH1/N84S/Q39K/S183E/CLD201/hole/SIDE/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4729 - protein, 437 aa, synthetic construct
  REGION 1..437: note = R_VK-x-CH1/Q38E/S183K/knob/SIDE
QIVLSQSPAILSASPGEKVTMTCRASSSVSYIHWFQEKPGSSPKPWIYATSNLASGVPVRFSGSGSGTSYSLTISRVEAEDAATYYCQQWTSNPPTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4730 - protein, 437 aa, synthetic construct
  REGION 1..437: note = R_VK-x-CH1/Q38K/S183K/knob/SIDE
QIVLSQSPAILSASPGEKVTMTCRASSSVSYIHWFQKKPGSSPKPWIYATSNLASGVPVRFSGSGSGTSYSLTISRVEAEDAATYYCQQWTSNPPTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4731 - protein, 450 aa, synthetic construct
  REGION 1..450: note = R_VH-CH
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4732 - protein, 450 aa, synthetic construct
  REGION 1..450: note = R_VH-CH/SIDE
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4733 - protein, 606 aa, synthetic construct
  REGION 1..606: note = R_VH-CH1/CLD201/hole/RF
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4734 - protein, 450 aa, synthetic construct
  REGION 1..450: note = R_VH-CH1/knob
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4735 - protein, 606 aa, synthetic construct
  REGION 1..606: note = R_VH-CH1/CLD201/hole/SSDA/RF
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPDVFLFPPKPKDTLMISRTPEVTCVVVDVSHEDPEVKFNWYVDGVEVHNAKTKPREEQYNATYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4736 - protein, 450 aa, synthetic construct
  REGION 1..450: note = R_VH-CH1/knob/AILE
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4737 - protein, 606 aa, synthetic construct
  REGION 1..606: note = R_VH-CH1/CLD201/hole/AILE/RF
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4738 - protein, 450 aa, synthetic construct
  REGION 1..450: note = R_VH-CH1/knob/SSDA
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNATYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4739 - protein, 606 aa, synthetic construct
  REGION 1..606: note = R_VH-CH1/CLD201/hole/SIDE/RF
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4740 - protein, 450 aa, synthetic construct
  REGION 1..450: note = R_VH-CH1/knob/SIDE
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4741 - protein, 449 aa, synthetic construct
  REGION 1..449: note = FMC63_VH-CH/N84S
EVKLQESGPGLVAPSQSLSVTCTVSGVSLPDYGVSWIRQPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4742 - protein, 449 aa, synthetic construct
  REGION 1..449: note = FMC63_VH-CH/N84S/SIDE
EVKLQESGPGLVAPSQSLSVTCTVSGVSLPDYGVSWIRQPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4743 - protein, 605 aa, synthetic construct
  REGION 1..605: note = FMC63_VH-CH1/N84S/CLD201/hole/RF
EVKLQESGPGLVAPSQSLSVTCTVSGVSLPDYGVSWIRQPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4744 - protein, 449 aa, synthetic construct
  REGION 1..449: note = FMC63_VH-CH1/N84S/knob
EVKLQESGPGLVAPSQSLSVTCTVSGVSLPDYGVSWIRQPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4745 - protein, 605 aa, synthetic construct
  REGION 1..605: note = FMC63_VH-CH1/N84S/CLD201/hole/SSDA/RF
EVKLQESGPGLVAPSQSLSVTCTVSGVSLPDYGVSWIRQPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPDVFLFPPKPKDTLMISRTPEVTCVVVDVSHEDPEVKFNWYVDGVEVHNAKTKPREEQYNATYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4746 - protein, 449 aa, synthetic construct
  REGION 1..449: note = FMC63_VH-CH1/N84S/knob/AILE
EVKLQESGPGLVAPSQSLSVTCTVSGVSLPDYGVSWIRQPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4747 - protein, 605 aa, synthetic construct
  REGION 1..605: note = FMC63_VH-CH1/N84S/CLD201/hole/AILE/RF
EVKLQESGPGLVAPSQSLSVTCTVSGVSLPDYGVSWIRQPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4748 - protein, 449 aa, synthetic construct
  REGION 1..449: note = FMC63_VH-CH1/N84S/knob/SSDA
EVKLQESGPGLVAPSQSLSVTCTVSGVSLPDYGVSWIRQPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNATYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4749 - protein, 605 aa, synthetic construct
  REGION 1..605: note = FMC63_VH-CH1/N84S/CLD201/hole/SIDE/RF
EVKLQESGPGLVAPSQSLSVTCTVSGVSLPDYGVSWIRQPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4750 - protein, 449 aa, synthetic construct
  REGION 1..449: note = FMC63_VH-CH1/N84S/knob/SIDE
EVKLQESGPGLVAPSQSLSVTCTVSGVSLPDYGVSWIRQPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4751 - protein, 438 aa, synthetic construct
  REGION 1..438: note = FMC60_VK-x-CH1/Q38E/S183K/knob
DIQMTQSPSSLSASVGDRVTITCRASQDISKFLNWYQEKPGKAIKLLIYHTSRLHSGVPSRFSGSGSGTDFTLTISSLQPEDFATYYCQQGATLPYTFGPGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4752 - protein, 438 aa, synthetic construct
  REGION 1..438: note = FMC60_VK-x-CH1/Q38K/S183K/knob
DIQMTQSPSSLSASVGDRVTITCRASQDISKFLNWYQKKPGKAIKLLIYHTSRLHSGVPSRFSGSGSGTDFTLTISSLQPEDFATYYCQQGATLPYTFGPGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4753 - protein, 606 aa, synthetic construct
  REGION 1..606: note = R_VH-CH1/Q39E/S183E/CLD201/hole/RF
QVQLQQPGAELVKPGASVKMSCKASGYTFTSYNMHWVKETPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4754 - protein, 605 aa, synthetic construct
  REGION 1..605: note = FMC47_VH-CH1/N84S/Q39K/S183E/CLD201/hole/RF
QVQLVQSGGGVVQPGRSLRLSCAASGVSLPDYGVSWVRKAPGKGLEWVAVIWGSETTYYNSALKSRFTISRDNSKNTLYLQMSSLRAEDTAVYYCAKHYYYGGSFAMDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4755 - protein, 605 aa, synthetic construct
  REGION 1..605: note = FMC47_VH-CH1/N84S/Q39E/S183E/CLD201/hole/RF
QVQLVQSGGGVVQPGRSLRLSCAASGVSLPDYGVSWVREAPGKGLEWVAVIWGSETTYYNSALKSRFTISRDNSKNTLYLQMSSLRAEDTAVYYCAKHYYYGGSFAMDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4756 - protein, 606 aa, synthetic construct
  REGION 1..606: note = R_VH-CH1/Q39K/S183E/CLD201/hole/SD/RF
QVQLQQPGAELVKPGASVKMSCKASGYTFTSYNMHWVKKTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4757 - protein, 438 aa, synthetic construct
  REGION 1..438: note = FMC60_VK-x-CH1/Q38E/S183K/knob/IE
DIQMTQSPSSLSASVGDRVTITCRASQDISKFLNWYQEKPGKAIKLLIYHTSRLHSGVPSRFSGSGSGTDFTLTISSLQPEDFATYYCQQGATLPYTFGPGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4758 - protein, 438 aa, synthetic construct
  REGION 1..438: note = FMC60_VK-x-CH1/Q38K/S183K/knob/IE
DIQMTQSPSSLSASVGDRVTITCRASQDISKFLNWYQKKPGKAIKLLIYHTSRLHSGVPSRFSGSGSGTDFTLTISSLQPEDFATYYCQQGATLPYTFGPGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4759 - protein, 606 aa, synthetic construct
  REGION 1..606: note = R_VH-CH1/Q39E/S183E/CLD201/hole/SD/RF
QVQLQQPGAELVKPGASVKMSCKASGYTFTSYNMHWVKETPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4760 - protein, 605 aa, synthetic construct
  REGION 1..605: note = FMC47_VH-CH1/N84S/Q39K/S183E/CLD201/hole/SD/RF
QVQLVQSGGGVVQPGRSLRLSCAASGVSLPDYGVSWVRKAPGKGLEWVAVIWGSETTYYNSALKSRFTISRDNSKNTLYLQMSSLRAEDTAVYYCAKHYYYGGSFAMDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4761 - protein, 437 aa, synthetic construct
  REGION 1..437: note = R_VK-x-CH1/Q38E/S183K/knob/IE
QIVLSQSPAILSASPGEKVTMTCRASSSVSYIHWFQEKPGSSPKPWIYATSNLASGVPVRFSGSGSGTSYSLTISRVEAEDAATYYCQQWTSNPPTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4762 - protein, 437 aa, synthetic construct
  REGION 1..437: note = R_VK-x-CH1/Q38K/S183K/knob/IE
QIVLSQSPAILSASPGEKVTMTCRASSSVSYIHWFQKKPGSSPKPWIYATSNLASGVPVRFSGSGSGTSYSLTISRVEAEDAATYYCQQWTSNPPTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4763 - protein, 605 aa, synthetic construct
  REGION 1..605: note = FMC47_VH-CH1/N84S/Q39E/S183E/CLD201/hole/SD/RF
QVQLVQSGGGVVQPGRSLRLSCAASGVSLPDYGVSWVREAPGKGLEWVAVIWGSETTYYNSALKSRFTISRDNSKNTLYLQMSSLRAEDTAVYYCAKHYYYGGSFAMDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4764 - protein, 606 aa, synthetic construct
  REGION 1..606: note = R_VH-CH1/Q39K/S183E/CLD201/hole/IE/RF
QVQLQQPGAELVKPGASVKMSCKASGYTFTSYNMHWVKKTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4765 - protein, 438 aa, synthetic construct
  REGION 1..438: note = FMC60_VK-x-CH1/Q38E/S183K/knob/SD
DIQMTQSPSSLSASVGDRVTITCRASQDISKFLNWYQEKPGKAIKLLIYHTSRLHSGVPSRFSGSGSGTDFTLTISSLQPEDFATYYCQQGATLPYTFGPGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4766 - protein, 438 aa, synthetic construct
  REGION 1..438: note = FMC60_VK-x-CH1/Q38K/S183K/knob/SD
DIQMTQSPSSLSASVGDRVTITCRASQDISKFLNWYQKKPGKAIKLLIYHTSRLHSGVPSRFSGSGSGTDFTLTISSLQPEDFATYYCQQGATLPYTFGPGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4767 - protein, 606 aa, synthetic construct
  REGION 1..606: note = R_VH-CH1/Q39E/S183E/CLD201/hole/IE/RF
QVQLQQPGAELVKPGASVKMSCKASGYTFTSYNMHWVKETPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4768 - protein, 605 aa, synthetic construct
  REGION 1..605: note = FMC47_VH-CH1/N84S/Q39K/S183E/CLD201/hole/IE/RF
QVQLVQSGGGVVQPGRSLRLSCAASGVSLPDYGVSWVRKAPGKGLEWVAVIWGSETTYYNSALKSRFTISRDNSKNTLYLQMSSLRAEDTAVYYCAKHYYYGGSFAMDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4769 - protein, 437 aa, synthetic construct
  REGION 1..437: note = R_VK-x-CH1/Q38E/S183K/knob/SD
QIVLSQSPAILSASPGEKVTMTCRASSSVSYIHWFQEKPGSSPKPWIYATSNLASGVPVRFSGSGSGTSYSLTISRVEAEDAATYYCQQWTSNPPTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4770 - protein, 437 aa, synthetic construct
  REGION 1..437: note = R_VK-x-CH1/Q38K/S183K/knob/SD
QIVLSQSPAILSASPGEKVTMTCRASSSVSYIHWFQKKPGSSPKPWIYATSNLASGVPVRFSGSGSGTSYSLTISRVEAEDAATYYCQQWTSNPPTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4771 - protein, 605 aa, synthetic construct
  REGION 1..605: note = FMC47_VH-CH1/N84S/Q39E/S183E/CLD201/hole/IE/RF
QVQLVQSGGGVVQPGRSLRLSCAASGVSLPDYGVSWVREAPGKGLEWVAVIWGSETTYYNSALKSRFTISRDNSKNTLYLQMSSLRAEDTAVYYCAKHYYYGGSFAMDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4772 - protein, 438 aa, synthetic construct
  REGION 1..438: note = FMC60_VK-x-CH1/Q38E/S183K/knob/SIDE
DIQMTQSPSSLSASVGDRVTITCRASQDISKFLNWYQEKPGKAIKLLIYHTSRLHSGVPSRFSGSGSGTDFTLTISSLQPEDFATYYCQQGATLPYTFGPGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4773 - protein, 438 aa, synthetic construct
  REGION 1..438: note = FMC60_VK-x-CH1/Q38K/S183K/knob/SIDE
DIQMTQSPSSLSASVGDRVTITCRASQDISKFLNWYQKKPGKAIKLLIYHTSRLHSGVPSRFSGSGSGTDFTLTISSLQPEDFATYYCQQGATLPYTFGPGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4774 - protein, 606 aa, synthetic construct
  REGION 1..606: note = R_VH-CH1/Q39EK/S183E/CLD201/hole/SIDE/RF
QVQLQQPGAELVKPGASVKMSCKASGYTFTSYNMHWVKETPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4775 - protein, 605 aa, synthetic construct
  REGION 1..605: note = FMC47_VH-CH1/N84S/Q39K/S183E/CLD201/hole/SIDE/RF
QVQLVQSGGGVVQPGRSLRLSCAASGVSLPDYGVSWVRKAPGKGLEWVAVIWGSETTYYNSALKSRFTISRDNSKNTLYLQMSSLRAEDTAVYYCAKHYYYGGSFAMDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4776 - protein, 605 aa, synthetic construct
  REGION 1..605: note = FMC47_VH-CH1/N84S/Q39E/S183E/CLD201/hole/SIDE/RF
QVQLVQSGGGVVQPGRSLRLSCAASGVSLPDYGVSWVREAPGKGLEWVAVIWGSETTYYNSALKSRFTISRDNSKNTLYLQMSSLRAEDTAVYYCAKHYYYGGSFAMDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4777 - protein, 449 aa, synthetic construct
  REGION 1..449: note = FMC47_VH-CH/N84S
QVQLVQSGGGVVQPGRSLRLSCAASGVSLPDYGVSWVRQAPGKGLEWVAVIWGSETTYYNSALKSRFTISRDNSKNTLYLQMSSLRAEDTAVYYCAKHYYYGGSFAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4778 - protein, 449 aa, synthetic construct
  REGION 1..449: note = FMC47_VH-CH/N84S/SIDE
QVQLVQSGGGVVQPGRSLRLSCAASGVSLPDYGVSWVRQAPGKGLEWVAVIWGSETTYYNSALKSRFTISRDNSKNTLYLQMSSLRAEDTAVYYCAKHYYYGGSFAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4779 - protein, 605 aa, synthetic construct
  REGION 1..605: note = FMC47_VH-CH1/N84S/CLD201/hole/RF
QVQLVQSGGGVVQPGRSLRLSCAASGVSLPDYGVSWVRQAPGKGLEWVAVIWGSETTYYNSALKSRFTISRDNSKNTLYLQMSSLRAEDTAVYYCAKHYYYGGSFAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4780 - protein, 449 aa, synthetic construct
  REGION 1..449: note = FMC47_VH-CH1/N84S/knob
QVQLVQSGGGVVQPGRSLRLSCAASGVSLPDYGVSWVRQAPGKGLEWVAVIWGSETTYYNSALKSRFTISRDNSKNTLYLQMSSLRAEDTAVYYCAKHYYYGGSFAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4781 - protein, 605 aa, synthetic construct
  REGION 1..605: note = FMC47_VH-CH1/N84S/CLD201/hole/SD/RF
QVQLVQSGGGVVQPGRSLRLSCAASGVSLPDYGVSWVRQAPGKGLEWVAVIWGSETTYYNSALKSRFTISRDNSKNTLYLQMSSLRAEDTAVYYCAKHYYYGGSFAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4782 - protein, 449 aa, synthetic construct
  REGION 1..449: note = FMC47_VH-CH1/N84S/knob/IE
QVQLVQSGGGVVQPGRSLRLSCAASGVSLPDYGVSWVRQAPGKGLEWVAVIWGSETTYYNSALKSRFTISRDNSKNTLYLQMSSLRAEDTAVYYCAKHYYYGGSFAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4783 - protein, 605 aa, synthetic construct
  REGION 1..605: note = FMC47_VH-CH1/N84S/CLD201/hole/IE/RF
QVQLVQSGGGVVQPGRSLRLSCAASGVSLPDYGVSWVRQAPGKGLEWVAVIWGSETTYYNSALKSRFTISRDNSKNTLYLQMSSLRAEDTAVYYCAKHYYYGGSFAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4784 - protein, 449 aa, synthetic construct
  REGION 1..449: note = FMC47_VH-CH1/N84S/knob/SD
QVQLVQSGGGVVQPGRSLRLSCAASGVSLPDYGVSWVRQAPGKGLEWVAVIWGSETTYYNSALKSRFTISRDNSKNTLYLQMSSLRAEDTAVYYCAKHYYYGGSFAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4785 - protein, 605 aa, synthetic construct
  REGION 1..605: note = FMC47_VH-CH1/N84S/CLD201/hole/SIDE/RF
QVQLVQSGGGVVQPGRSLRLSCAASGVSLPDYGVSWVRQAPGKGLEWVAVIWGSETTYYNSALKSRFTISRDNSKNTLYLQMSSLRAEDTAVYYCAKHYYYGGSFAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4786 - protein, 449 aa, synthetic construct
  REGION 1..449: note = FMC47_VH-CH1/N84S/knob/SIDE
QVQLVQSGGGVVQPGRSLRLSCAASGVSLPDYGVSWVRQAPGKGLEWVAVIWGSETTYYNSALKSRFTISRDNSKNTLYLQMSSLRAEDTAVYYCAKHYYYGGSFAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4787 - protein, 438 aa, synthetic construct
  REGION 1..438: note = FMC59_VK-x-CH1/Q38E/S183K/knob
DIQMTQSPSSLSASVGDRVTITCRASQDISKYLNWYQEKPGKAIKLLIYHTSRLHSGVPSRFSGSGSGTDFTLTISSLQPEDFATYYCQQGATLPYTFGPGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4788 - protein, 438 aa, synthetic construct
  REGION 1..438: note = FMC59_VK-x-CH1/Q38K/S183K/knob
DIQMTQSPSSLSASVGDRVTITCRASQDISKYLNWYQKKPGKAIKLLIYHTSRLHSGVPSRFSGSGSGTDFTLTISSLQPEDFATYYCQQGATLPYTFGPGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4789 - protein, 438 aa, synthetic construct
  REGION 1..438: note = FMC59_VK-x-CH1/Q38E/S183K/knob/IE
DIQMTQSPSSLSASVGDRVTITCRASQDISKYLNWYQEKPGKAIKLLIYHTSRLHSGVPSRFSGSGSGTDFTLTISSLQPEDFATYYCQQGATLPYTFGPGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4790 - protein, 438 aa, synthetic construct
  REGION 1..438: note = FMC59_VK-x-CH1/Q38K/S183K/knob/IE
DIQMTQSPSSLSASVGDRVTITCRASQDISKYLNWYQKKPGKAIKLLIYHTSRLHSGVPSRFSGSGSGTDFTLTISSLQPEDFATYYCQQGATLPYTFGPGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4791 - protein, 438 aa, synthetic construct
  REGION 1..438: note = FMC59_VK-x-CH1/Q38E/S183K/knob/SD
DIQMTQSPSSLSASVGDRVTITCRASQDISKYLNWYQEKPGKAIKLLIYHTSRLHSGVPSRFSGSGSGTDFTLTISSLQPEDFATYYCQQGATLPYTFGPGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4792 - protein, 438 aa, synthetic construct
  REGION 1..438: note = FMC59_VK-x-CH1/Q38K/S183K/knob/SD
DIQMTQSPSSLSASVGDRVTITCRASQDISKYLNWYQKKPGKAIKLLIYHTSRLHSGVPSRFSGSGSGTDFTLTISSLQPEDFATYYCQQGATLPYTFGPGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4793 - protein, 438 aa, synthetic construct
  REGION 1..438: note = FMC59_VK-x-CH1/Q38E/S183K/knob/SIDE
DIQMTQSPSSLSASVGDRVTITCRASQDISKYLNWYQEKPGKAIKLLIYHTSRLHSGVPSRFSGSGSGTDFTLTISSLQPEDFATYYCQQGATLPYTFGPGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4794 - protein, 438 aa, synthetic construct
  REGION 1..438: note = FMC59_VK-x-CH1/Q38K/S183K/knob/SIDE
DIQMTQSPSSLSASVGDRVTITCRASQDISKYLNWYQKKPGKAIKLLIYHTSRLHSGVPSRFSGSGSGTDFTLTISSLQPEDFATYYCQQGATLPYTFGPGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4795 - protein, 606 aa, synthetic construct; identical to SEQ ID NO: 593
  REGION 1..606: note = B13A_VH-CH1/N84S/Q39K/S183E/CLD201/hole/RF

SEQ ID NO: 4796 - protein, 442 aa, synthetic construct; identical to SEQ ID NO: 594
  REGION 1..442: note = O24A_VK-x-CH1/Q38E/S183K/knob

SEQ ID NO: 4797 - protein, 442 aa, synthetic construct; identical to SEQ ID NO: 595
  REGION 1..442: note = O24A_VK-x-CH1/Q38K/S183K/knob

SEQ ID NO: 4798 - protein, 603 aa, synthetic construct; identical to SEQ ID NO: 603
  REGION 1..603: note = O24A_VH-CH1/N84S/Q39K/S183E/CLD201/hole/RF

SEQ ID NO: 4799 - protein, 438 aa, synthetic construct; identical to SEQ ID NO: 604
  REGION 1..438: note = B13A_VK-x-CH1/Q38E/S183K/knob

SEQ ID NO: 4800 - protein, 438 aa, synthetic construct; identical to SEQ ID NO: 605
  REGION 1..438: note = B13A_VK-x-CH1/Q38K/S183K/knob

SEQ ID NO: 4801 - protein, 213 aa, synthetic construct; identical to SEQ ID NO: 733
  REGION 1..213: note = R_VK-Ck/E123R/Q124K

SEQ ID NO: 4802 - protein, 227 aa, synthetic construct; identical to SEQ ID NO: 734
  REGION 1..227: note = FMC63_VH-x-CK/N84S

SEQ ID NO: 4803 - protein, 213 aa, synthetic construct; identical to SEQ ID NO: 735
  REGION 1..213: note = R_VK-CK/Q38E/V133K

SEQ ID NO: 4804 - protein, 227 aa, synthetic construct; identical to SEQ ID NO: 736
  REGION 1..227: note = FMC63_VH-x-CK/N84S/Q39K/V133E

SEQ ID NO: 4805 - protein, 227 aa, synthetic construct; identical to SEQ ID NO: 737
  REGION 1..227: note = FMC63_VH-x-CK/N84S/Q39E/V133E

SEQ ID NO: 4806 - protein, 214 aa, synthetic construct; identical to SEQ ID NO: 738
  REGION 1..214: note = FMC63_VK-Ck/E123R/Q124K

SEQ ID NO: 4807 - protein, 228 aa, synthetic construct; identical to SEQ ID NO: 739
  REGION 1..228: note = R_VH-x-CK

SEQ ID NO: 4808 - protein, 214 aa, synthetic construct; identical to SEQ ID NO: 740
  REGION 1..214: note = FMC63_VK-CK/Q38E/V133K

SEQ ID NO: 4809 - protein, 228 aa, synthetic construct; identical to SEQ ID NO: 741
  REGION 1..228: note = R_VH-x-CK/Q39K/V133E

SEQ ID NO: 4810 - protein, 228 aa, synthetic construct; identical to SEQ ID NO: 742
  REGION 1..228: note = R_VH-x-CK/Q39E/V133E

SEQ ID NO: 4811 - protein, 213 aa, synthetic construct; identical to SEQ ID NO: 1
  REGION 1..213: note = R_VK-Ck

SEQ ID NO: 4812 - protein, 214 aa, synthetic construct
  REGION 1..214: note = FMC63_VK-Ck
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4813 - protein, 227 aa, synthetic construct
  REGION 1..227: note = FMC47_VH-x-CK/N84S/Q39K/V133E
QVQLVQSGGGVVQPGRSLRLSCAASGVSLPDYGVSWVRKAPGKGLEWVAVIWGSETTYYNSALKSRFTISRDNSKNTLYLQMSSLRAEDTAVYYCAKHYYYGGSFAMDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 4814 - protein, 227 aa, synthetic construct
  REGION 1..227: note = FMC47_VH-x-CK/N84S/Q39E/V133E
QVQLVQSGGGVVQPGRSLRLSCAASGVSLPDYGVSWVREAPGKGLEWVAVIWGSETTYYNSALKSRFTISRDNSKNTLYLQMSSLRAEDTAVYYCAKHYYYGGSFAMDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 4815 - protein, 213 aa, synthetic construct
  REGION 1..213: note = R_VK-CK/Q38K/V133K
QIVLSQSPAILSASPGEKVTMTCRASSSVSYIHWFQKKPGSSPKPWIYATSNLASGVPVRFSGSGSGTSYSLTISRVEAEDAATYYCQQWTSNPPTFGGGTKLEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 4816 - protein, 214 aa, synthetic construct
  REGION 1..214: note = FMC60_VK-CK/Q38E/V133K
DIQMTQSPSSLSASVGDRVTITCRASQDISKFLNWYQEKPGKAIKLLIYHTSRLHSGVPSRFSGSGSGTDFTLTISSLQPEDFATYYCQQGATLPYTFGPGTKLEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 4817 - protein, 214 aa, synthetic construct
  REGION 1..214: note = FMC60_VK-CK/Q38K/V133K
DIQMTQSPSSLSASVGDRVTITCRASQDISKFLNWYQKKPGKAIKLLIYHTSRLHSGVPSRFSGSGSGTDFTLTISSLQPEDFATYYCQQGATLPYTFGPGTKLEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 4818 - protein, 214 aa, synthetic construct
  REGION 1..214: note = FMC60_VK-Ck
DIQMTQSPSSLSASVGDRVTITCRASQDISKFLNWYQQKPGKAIKLLIYHTSRLHSGVPSRFSGSGSGTDFTLTISSLQPEDFATYYCQQGATLPYTFGPGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4819 - protein, 214 aa, synthetic construct
  REGION 1..214: note = FMC59_VK-CK/Q38E/V133K
DIQMTQSPSSLSASVGDRVTITCRASQDISKYLNWYQEKPGKAIKLLIYHTSRLHSGVPSRFSGSGSGTDFTLTISSLQPEDFATYYCQQGATLPYTFGPGTKLEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 4820 - protein, 214 aa, synthetic construct
  REGION 1..214: note = FMC59_VK-CK/Q38K/V133K
DIQMTQSPSSLSASVGDRVTITCRASQDISKYLNWYQKKPGKAIKLLIYHTSRLHSGVPSRFSGSGSGTDFTLTISSLQPEDFATYYCQQGATLPYTFGPGTKLEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 4821 - protein, 214 aa, synthetic construct
  REGION 1..214: note = FMC59_VK-Ck
DIQMTQSPSSLSASVGDRVTITCRASQDISKYLNWYQQKPGKAIKLLIYHTSRLHSGVPSRFSGSGSGTDFTLTISSLQPEDFATYYCQQGATLPYTFGPGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4822 - protein, 214 aa, synthetic construct; identical to SEQ ID NO: 633
  REGION 1..214: note = B13A_VK-CK/Q38E/V133K

SEQ ID NO: 4823 - protein, 225 aa, synthetic construct; identical to SEQ ID NO: 634
  REGION 1..225: note = O24A_VH-x-CK/Q39K/V133E

SEQ ID NO: 4824 - protein, 225 aa, synthetic construct; identical to SEQ ID NO: 635
  REGION 1..225: note = O24A_VH-x-CK/Q39E/V133E

SEQ ID NO: 4825 - protein, 218 aa, synthetic construct; identical to SEQ ID NO: 638
  REGION 1..218: note = O24A_VK-CK/Q38E/V133K

SEQ ID NO: 4826 - protein, 228 aa, synthetic construct; identical to SEQ ID NO: 639
  REGION 1..228: note = B13A_VH-x-CK/Q39K/V133E

SEQ ID NO: 4827 - protein, 228 aa, synthetic construct; identical to SEQ ID NO: 640
  REGION 1..228: note = B13A_VH-x-CK/Q39E/V133E

SEQ ID NO: 4828 - protein, 221 aa, synthetic construct
  REGION 1..221: note = Fc6/knob
CPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4829 - protein, 221 aa, synthetic construct
  REGION 1..221: note = Fc6/knob/SIDE
CPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4830 - protein, 453 aa, synthetic construct
  REGION 1..453: note = ADG-20_VH-CH
EVQLVESGGGLVKPGGSLRLSCAASGFTFSSYYMNWVRQAPGKGLEWVSSISEDGYSTYYPDSLKGRFTISRDSAKNSLYLQMNSLRADDTAVYYCARDFSGHTAWAGTGFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHYTQKSLSLSPG

SEQ ID NO: 4831 - protein, 450 aa, synthetic construct
  REGION 1..450: note = Ta_VH-CH/SIDE
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVQFNWYVDGVEVHNAKTKPREEQFNSTFRVVSVLTVVHQDWLNGKEYKCKVSNKALPAPEEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 4832 - protein, 453 aa, synthetic construct
  REGION 1..453: note = M971_VH-CH
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4833 - protein, 453 aa, synthetic construct
  REGION 1..453: note = M971_VH-CH/SIDE
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4834 - protein, 451 aa, synthetic construct
  REGION 1..451: note = Of_VH-CH
EVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4835 - protein, 451 aa, synthetic construct
  REGION 1..451: note = Oc4041_VH-CH
EVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNATYRVVSVLTVLHQDWLNGKEYKCKVSNKALPAPIAATISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4836 - protein, 448 aa, synthetic construct
  REGION 1..448: note = MoH1_VH-CH/N84G/hole
EVQLVQSGAEVKKPGASVKVSCKASGYTFTNYYIHWVRQAPGQGLEWIGWIYPGDGNTKYNEKFKGRATLTADTSTSTAYLELSSLRSEDTAVYYCARDSYSNYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 4837 - protein, 451 aa, synthetic construct
  REGION 1..451: note = MoH2_VH-CH/N84G/knob
EVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4838 - protein, 466 aa, synthetic construct
  REGION 1..466: note = TNFR1B_Fc
LPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4839 - protein, 450 aa, synthetic construct
  REGION 1..450: note = Ad_VH-CH
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4840 - protein, 450 aa, synthetic construct
  REGION 1..450: note = Ve_VH-CH
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGGYDGWDYAIDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4841 - protein, 448 aa, synthetic construct
  REGION 1..448: note = Us_VH-CH
EVQLVQSGAEVKKPGESLKISCKGSGYSFTTYWLGWVRQMPGKGLDWIGIMSPVDSDIRYSPSFQGQVTMSVDKSITTAYLQWNSLKASDTAMYYCARRRPGQGYFDFWGQGTLVTVSSSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4842 - protein, 456 aa, synthetic construct
  REGION 1..456: note = Se_VH-CH
EVQLVESGGGLVQPGGSLRLSCAASGFTFSNYWMNWVRQAPGKGLEWVAAINQDGSEKYYVGSVKGRFTISRDNAKNSLYLQMNSLRVEDTAVYYCVRDYYDILTDYYIHYWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4843 - protein, 446 aa, synthetic construct
  REGION 1..446: note = Pe_VH-CH
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 4844 - protein, 447 aa, synthetic construct
  REGION 1..447: note = Ip_VH-CH
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4845 - protein, 446 aa, synthetic construct
  REGION 1..446: note = 388D4-3_VH-CH
EVQLVQSGAEVKKPGASVKVSCKASGYTFTDYEMHWVRQAPGQGLEWMGIIDPGTGGTAYNQKFQGRVTMTADKSTSTVYMELSSLRSEDTAVYYCTSEKFGSNYYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 4846 - protein, 446 aa, synthetic construct
  REGION 1..446: note = 244C8-2_VH-CH
QVQLVQSGAEVKKPGASVKVSCKASGYTFTSYWMHWVRQAPGQGLEWMGMIDPSNSETSLNQKFQGRVTMTVDKSTNTVYMELSSLRSEDTAVYYCARSRGNYAYEMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 4847 - protein, 447 aa, synthetic construct
  REGION 1..447: note = At_VH-CH/N297A
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4848 - protein, 449 aa, synthetic construct
  REGION 1..449: note = B60-55_VH-CH/FES
QVQLVQSGAEVKKPASSVKVSCTASGGSFSTYAISWVRQAPGQGLEWMGGIIPIFGTTKYAQRFQGRVTITADESTTTAYMELSSLISDDTALYYCTTSRGFNYGWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4849 - protein, 218 aa, synthetic construct
  REGION 1..218: note = ADG-20_VL-CL
QSVLTQPPSVSGAPGQRITISCTGSSSNIGAGYDVHWYQQLPGTAPKLLIYGSSSRNSGVPDRFSGSKSGTSASLAITGLQAEDEADYYCQSYDSSLSVLYTFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4850 - protein, 219 aa, synthetic construct
  REGION 1..219: note = Ta_VK-Ck
DIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4851 - protein, 214 aa, synthetic construct
  REGION 1..214: note = M971_VK-Ck
DIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4852 - protein, 214 aa, synthetic construct
  REGION 1..214: note = Of_VK-CK
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4853 - protein, 213 aa, synthetic construct
  REGION 1..213: note = Oc4041_VK-CK
DIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4854 - protein, 219 aa, synthetic construct
  REGION 1..219: note = MoL1_VK-CK
DIVMTQSPDSLAVSLGERATINCKSSQSLLNSRTRKNYLAWYQQKPGQPPKLLIYWASTRESGVPDRFSGSGSGTDFTLTISSLQAEDVAVYYCTQSFILRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4855 - protein, 213 aa, synthetic construct; identical to SEQ ID NO: 4853
  REGION 1..213: note = MoL2_VK-CK

SEQ ID NO: 4856 - protein, 214 aa, synthetic construct; identical to SEQ ID NO: 238
  REGION 1..214: note = Ad_VK-CK

SEQ ID NO: 4857 - protein, 219 aa, synthetic construct
  REGION 1..219: note = Ve_VK-CK
DVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQGTHQPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4858 - protein, 214 aa, synthetic construct
  REGION 1..214: note = Us_VK-CK
DIQMTQSPSSLSASVGDRVTITCRASQGISSWLAWYQQKPEKAPKSLIYAASSLQSGVPSRFSGSGSGTDFTLTISSLQPEDFATYYCQQYNIYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4859 - protein, 215 aa, synthetic construct
  REGION 1..215: note = Se_VK-CK
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPCTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4860 - protein, 218 aa, synthetic construct
  REGION 1..218: note = Pe_VK-CK
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4861 - protein, 215 aa, synthetic construct
  REGION 1..215: note = Ip_VK-CK
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4862 - protein, 219 aa, synthetic construct
  REGION 1..219: note = 388D4-3_VK-CK
DIVMTQTPLSSPVTLGQPASISCRSSQTIVHSDGNTYLEWYQQRPGQPPRLLIYKVSNRFSGVPDRFSGSGAGTDFTLKISRVEAEDVGVYYCFQGSHVPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4863 - protein, 215 aa, synthetic construct
  REGION 1..215: note = 244C8-2_VK-CK
DIVLTQSPGTLSLSPGEKVTLSCRASSSVSSNYLYWYQQKPGQAPRLVIYSTSNLATGIPDRFSGSGSGTDYTLTISRLEPEDFAVYFCHQWSSYPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4864 - protein, 214 aa, synthetic construct
  REGION 1..214: note = At_VK-CK
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4865 - protein, 214 aa, synthetic construct
  REGION 1..214: note = B60-55_VK-CK
EIVMTQSPATLSLSPGERATLSCRASQSVGIHLAWYQQKLGQAPRLLIYGASSRATGIPDRFSGSGSGTDFTLTISRLEPEDFAVYYCQQYGSLPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4866 - protein, 606 aa, synthetic construct
  REGION 1..606: note = Ad_VH-CH1/N84S/Q39K/S183E/CLD201/hole/RF
EVQLVESGGGLVQPGRSLRLSCAASGFTFDDYAMHWVRKAPGKGLEWVSAITWNSGHIDYADSVEGRFTISRDNAKNSLYLQMSSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4867 - protein, 438 aa, synthetic construct
  REGION 1..438: note = Us_VK-x-CH1/Q38E/S183K/knob
DIQMTQSPSSLSASVGDRVTITCRASQGISSWLAWYQKKPEKAPKSLIYAASSLQSGVPSRFSGSGSGTDFTLTISSLQPEDFATYYCQQYNIYPYTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4868 - protein, 438 aa, synthetic construct
  REGION 1..438: note = Us_VK-x-CH1/Q38K/S183K/knob
DIQMTQSPSSLSASVGDRVTITCRASQGISSWLAWYQEKPEKAPKSLIYAASSLQSGVPSRFSGSGSGTDFTLTISSLQPEDFATYYCQQYNIYPYTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4869 - protein, 606 aa, synthetic construct
  REGION 1..606: note = Ad_VH-CH1/N84S/Q39E/S183E/CLD201/hole/RF
EVQLVESGGGLVQPGRSLRLSCAASGFTFDDYAMHWVREAPGKGLEWVSAITWNSGHIDYADSVEGRFTISRDNAKNSLYLQMSSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4870 - protein, 604 aa, synthetic construct
  REGION 1..604: note = Us_VH-CH1/N84S/Q39K/S183E/CLD201/hole/RF
EVQLVQSGAEVKKPGESLKISCKGSGYSFTTYWLGWVRKMPGKGLDWIGIMSPVDSDIRYSPSFQGQVTMSVDKSITTAYLQWSSLKASDTAMYYCARRRPGQGYFDFWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4871 - protein, 438 aa, synthetic construct
  REGION 1..438: note = Ad_VK-x-CH1/Q38E/S183K/knob
DIQMTQSPSSLSASVGDRVTITCRASQGIRNYLAWYQEKPGKAPKLLIYAASTLQSGVPSRFSGSGSGTDFTLTISSLQPEDVATYYCQRYNRAPYTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4872 - protein, 438 aa, synthetic construct
  REGION 1..438: note = Ad_VK-x-CH1/Q38K/S183K/knob
DIQMTQSPSSLSASVGDRVTITCRASQGIRNYLAWYQKKPGKAPKLLIYAASTLQSGVPSRFSGSGSGTDFTLTISSLQPEDVATYYCQRYNRAPYTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4873 - protein, 604 aa, synthetic construct
  REGION 1..604: note = Us_VH-CH1/N84S/Q39E/S183E/CLD201/hole/RF
EVQLVQSGAEVKKPGESLKISCKGSGYSFTTYWLGWVREMPGKGLDWIGIMSPVDSDIRYSPSFQGQVTMSVDKSITTAYLQWSSLKASDTAMYYCARRRPGQGYFDFWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4874 - protein, 439 aa, synthetic construct
  REGION 1..439: note = Se_VK-x-CH1/Q38E/S183K/knob
EIVLTQSPGTLSLSPGERATLSCRASQSVSSSYLAWYQEKPGQAPRLLIYGASSRATGIPDRFSGSGSGTDFTLTISRLEPEDFAVYYCQQYGSSPCTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4875 - protein, 439 aa, synthetic construct
  REGION 1..439: note = Se_VK-x-CH1/Q38K/S183K/knob
EIVLTQSPGTLSLSPGERATLSCRASQSVSSSYLAWYQKKPGQAPRLLIYGASSRATGIPDRFSGSGSGTDFTLTISRLEPEDFAVYYCQQYGSSPCTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4876 - protein, 612 aa, synthetic construct
  REGION 1..612: note = Se_VH-CH1/N84S/Q39K/S183E/CLD201/hole/RF
EVQLVESGGGLVQPGGSLRLSCAASGFTFSNYWMNWVRKAPGKGLEWVAAINQDGSEKYYVGSVKGRFTISRDNAKNSLYLQMSSLRVEDTAVYYCVRDYYDILTDYYIHYWYFDLWGRGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4877 - protein, 612 aa, synthetic construct
  REGION 1..612: note = Se_VH-CH1/N84S/Q39E/S183E/CLD201/hole/RF
EVQLVESGGGLVQPGGSLRLSCAASGFTFSNYWMNWVREAPGKGLEWVAAINQDGSEKYYVGSVKGRFTISRDNAKNSLYLQMSSLRVEDTAVYYCVRDYYDILTDYYIHYWYFDLWGRGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4878 - protein, 606 aa, synthetic construct
  REGION 1..606: note = Ad_VH-CH1/N84S/Q39K/S183E/CLD201/hole/LALA/RF
EVQLVESGGGLVQPGRSLRLSCAASGFTFDDYAMHWVRKAPGKGLEWVSAITWNSGHIDYADSVEGRFTISRDNAKNSLYLQMSSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4879 - protein, 443 aa, synthetic construct
  REGION 1..443: note = Ve_VK-x-CH1/Q38E/S183K/knob/LALA
DVVMTQSPLSLPVTPGEPASISCRSSQSLAKSYGNTYLSWYLEKPGQSPQLLIYGISNRFSGVPDRFSGSGSGTDFTLKISRVEAEDVGVYYCLQGTHQPYTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4880 - protein, 438 aa, synthetic construct
  REGION 1..438: note = Ve_VK-x-CH1/Q38K/S183K/knob/LALA
DVVMTQSPLSLPVTPGEPASISCRSSQSLAKSYGNTYLSWYLKKPGQSPQLLIYGISNRFSGVPDRFSGSGSGTDFTLKISRVEAEDVGVYYCLQGTHQPYTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4881 - protein, 601 aa, synthetic construct
  REGION 1..601: note = Ad_VH-CH1/N84S/Q39E/S183E/CLD201/hole/LALA/RF
EVQLVESGGGLVQPGRSLRLSCAASGFTFDDYAMHWVREAPGKGLEWVSAITWNSGHIDYADSVEGRFTISRDNAKNSLYLQMSSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4882 - protein, 601 aa, synthetic construct
  REGION 1..601: note = Ve_VH-CH1/Q39K/S183E/CLD201/hole/LALA/RF
QVQLVQSGAEVKKPGASVKVSCKGSGYTFTSYWMHWVRKAPGQRLEWIGEIDPSESNTNYNQKFKGRVTLTVDISASTAYMELSSLRSEDTAVYYCARGGYDGWDYAIDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4883 - protein, 433 aa, synthetic construct
  REGION 1..433: note = Ad_VK-x-CH1/Q38E/S183K/knob/LALA
DIQMTQSPSSLSASVGDRVTITCRASQGIRNYLAWYQEKPGKAPKLLIYAASTLQSGVPSRFSGSGSGTDFTLTISSLQPEDVATYYCQRYNRAPYTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4884 - protein, 433 aa, synthetic construct
  REGION 1..433: note = Ad_VK-x-CH1/Q38K/S183K/knob/LALA
DIQMTQSPSSLSASVGDRVTITCRASQGIRNYLAWYQKKPGKAPKLLIYAASTLQSGVPSRFSGSGSGTDFTLTISSLQPEDVATYYCQRYNRAPYTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4885 - protein, 601 aa, synthetic construct
  REGION 1..601: note = Ve_VH-CH1/Q39E/S183E/CLD201/hole/LALA/RF
QVQLVQSGAEVKKPGASVKVSCKGSGYTFTSYWMHWVREAPGQRLEWIGEIDPSESNTNYNQKFKGRVTLTVDISASTAYMELSSLRSEDTAVYYCARGGYDGWDYAIDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4886 - protein, 807 aa, synthetic construct
  REGION 1..807: note = TNFR1B_201/CLD201/Ad_VH-CH/N84S/hole/RF
LPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTREVQLVESGGGLVQPGRSLRLSCAASGFTFDDYAMHWVRQAPGKGLEWVSAITWNSGHIDYADSVEGRFTISRDNAKNSLYLQMSSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4887 - protein, 795 aa, synthetic construct
  REGION 1..795: note = TNFR1B_201/CLD201/Ad_VK-x-CH/hole/RF
LPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4888 - protein, 805 aa, synthetic construct
  REGION 1..805: note = TNFR1B_201/CLD201/Us_VH-CH/N84S/hole/RF
LPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTREVQLVQSGAEVKKPGESLKISCKGSGYSFTTYWLGWVRQMPGKGLDWIGIMSPVDSDIRYSPSFQGQVTMSVDKSITTAYLQWSSLKASDTAMYYCARRRPGQGYFDFWGQGTLVTVSSSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4889 - protein, 795 aa, synthetic construct
  REGION 1..795: note = TNFR1B_201/CLD201/Us_VK-x-CH/hole/RF
LPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDIQMTQSPSSLSASVGDRVTITCRASQGISSWLAWYQQKPEKAPKSLIYAASSLQSGVPSRFSGSGSGTDFTLTISSLQPEDFATYYCQQYNIYPYTFGQGTKVEIKSSSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4890 - protein, 813 aa, synthetic construct
  REGION 1..813: note = TNFR1B_201/CLD201/Se_VH-CH/N84S/hole/RF
LPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTREVQLVESGGGLVQPGGSLRLSCAASGFTFSNYWMNWVRQAPGKGLEWVAAINQDGSEKYYVGSVKGRFTISRDNAKNSLYLQMSSLRVEDTAVYYCVRDYYDILTDYYIHYWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4891 - protein, 796 aa, synthetic construct
  REGION 1..796: note = TNFR1B_201/CLD201/Se_VK-x-CH/hole/RF
LPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTREIVLTQSPGTLSLSPGERATLSCRASQSVSSSYLAWYQQKPGQAPRLLIYGASSRATGIPDRFSGSGSGTDFTLTISRLEPEDFAVYYCQQYGSSPCTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4892 - protein, 807 aa, synthetic construct
  REGION 1..807: note = TNFR1B_201/CLD201/Ve_VH-CH/hole/LALA/RF
LPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRQVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGGYDGWDYAIDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4893 - protein, 800 aa, synthetic construct
  REGION 1..800: note = TNFR1B_201/CLD201/Ve_VK-x-CH/hole/LALA/RF
LPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQGTHQPYTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4894 - protein, 214 aa, synthetic construct
  REGION 1..214: note = Ad_VK-CK/Q38E/V133K
DIQMTQSPSSLSASVGDRVTITCRASQGIRNYLAWYQEKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 4895 - protein, 226 aa, synthetic construct
  REGION 1..226: note = Us_VH-x-CK/N84S/Q39K/V133E
EVQLVQSGAEVKKPGESLKISCKGSGYSFTTYWLGWVRKMPGKGLDWIGIMSPVDSDIRYSPSFQGQVTMSVDKSITTAYLQWSSLKASDTAMYYCARRRPGQGYFDFWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 4896 - protein, 226 aa, synthetic construct
  REGION 1..226: note = Us_VH-x-CK/N84S/Q39E/V133E
EVQLVQSGAEVKKPGESLKISCKGSGYSFTTYWLGWVREMPGKGLDWIGIMSPVDSDIRYSPSFQGQVTMSVDKSITTAYLQWSSLKASDTAMYYCARRRPGQGYFDFWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 4897 - protein, 214 aa, synthetic construct
  REGION 1..214: note = Ad_VK-CK/Q38K/V133K
DIQMTQSPSSLSASVGDRVTITCRASQGIRNYLAWYQKKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 4898 - protein, 214 aa, synthetic construct
  REGION 1..214: note = Us_VK-CK/Q38E/V133K
DIQMTQSPSSLSASVGDRVTITCRASQGISSWLAWYQEKPEKAPKSLIYAASSLQSGVPSRFSGSGSGTDFTLTISSLQPEDFATYYCQQYNIYPYTFGQGTKLEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 4899 - protein, 228 aa, synthetic construct
  REGION 1..228: note = Ad_VH-x-CK/N84S/Q39K/V133E
EVQLVESGGGLVQPGRSLRLSCAASGFTFDDYAMHWVRKAPGKGLEWVSAITWNSGHIDYADSVEGRFTISRDNAKNSLYLQMSSLRAEDTAVYYCAKVSYLSTASSLDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 4900 - protein, 228 aa, synthetic construct
  REGION 1..228: note = Ad_VH-x-CK/N84S/Q39E/V133E
EVQLVESGGGLVQPGRSLRLSCAASGFTFDDYAMHWVREAPGKGLEWVSAITWNSGHIDYADSVEGRFTISRDNAKNSLYLQMSSLRAEDTAVYYCAKVSYLSTASSLDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 4901 - protein, 214 aa, synthetic construct
  REGION 1..214: note = Us_VK-CK/Q38K/V133K
DIQMTQSPSSLSASVGDRVTITCRASQGISSWLAWYQKKPEKAPKSLIYAASSLQSGVPSRFSGSGSGTDFTLTISSLQPEDFATYYCQQYNIYPYTFGQGTKLEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 4902 - protein, 234 aa, synthetic construct
  REGION 1..234: note = Se_VH-x-CK/N84S/Q39K/V133E
EVQLVESGGGLVQPGGSLRLSCAASGFTFSNYWMNWVRKAPGKGLEWVAAINQDGSEKYYVGSVKGRFTISRDNAKNSLYLQMSSLRVEDTAVYYCVRDYYDILTDYYIHYWYFDLWGRGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 4903 - protein, 234 aa, synthetic construct
  REGION 1..234: note = Se_VH-x-CK/N84S/Q39E/V133E
EVQLVESGGGLVQPGGSLRLSCAASGFTFSNYWMNWVREAPGKGLEWVAAINQDGSEKYYVGSVKGRFTISRDNAKNSLYLQMSSLRVEDTAVYYCVRDYYDILTDYYIHYWYFDLWGRGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 4904 - protein, 215 aa, synthetic construct
  REGION 1..215: note = Se_VK-CK/Q38E/V133K
EIVLTQSPGTLSLSPGERATLSCRASQSVSSSYLAWYQEKPGQAPRLLIYGASSRATGIPDRFSGSGSGTDFTLTISRLEPEDFAVYYCQQYGSSPCTFGQGTKVEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 4905 - protein, 215 aa, synthetic construct
  REGION 1..215: note = Se_VK-CK/Q38K/V133K
EIVLTQSPGTLSLSPGERATLSCRASQSVSSSYLAWYQKKPGQAPRLLIYGASSRATGIPDRFSGSGSGTDFTLTISRLEPEDFAVYYCQQYGSSPCTFGQGTKVEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 4906 - protein, 228 aa, synthetic construct
  REGION 1..228: note = Ve_VH-x-CK/Q39K/V133E
QVQLVQSGAEVKKPGASVKVSCKGSGYTFTSYWMHWVRKAPGQRLEWIGEIDPSESNTNYNQKFKGRVTLTVDISASTAYMELSSLRSEDTAVYYCARGGYDGWDYAIDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 4907 - protein, 228 aa, synthetic construct
  REGION 1..228: note = Ve_VH-x-CK/Q39E/V133E
QVQLVQSGAEVKKPGASVKVSCKGSGYTFTSYWMHWVREAPGQRLEWIGEIDPSESNTNYNQKFKGRVTLTVDISASTAYMELSSLRSEDTAVYYCARGGYDGWDYAIDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 4908 - protein, 219 aa, synthetic construct
  REGION 1..219: note = Ve_VK-CK/Q38E/V133K
DVVMTQSPLSLPVTPGEPASISCRSSQSLAKSYGNTYLSWYLEKPGQSPQLLIYGISNRFSGVPDRFSGSGSGTDFTLKISRVEAEDVGVYYCLQGTHQPYTFGQGTKVEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 4909 - protein, 219 aa, synthetic construct
  REGION 1..219: note = Ve_VK-CK/Q38K/V133K
DVVMTQSPLSLPVTPGEPASISCRSSQSLAKSYGNTYLSWYLKKPGQSPQLLIYGISNRFSGVPDRFSGSGSGTDFTLKISRVEAEDVGVYYCLQGTHQPYTFGQGTKVEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 4910 - protein, 214 aa, synthetic construct; identical to SEQ ID NO: 238
  REGION 1..214: note = Ad_VK-CK

SEQ ID NO: 4911 - protein, 228 aa, synthetic construct
  REGION 1..228: note = Ad_VH-x-CK/N84S
EVQLVESGGGLVQPGRSLRLSCAASGFTFDDYAMHWVRQAPGKGLEWVSAITWNSGHIDYADSVEGRFTISRDNAKNSLYLQMSSLRAEDTAVYYCAKVSYLSTASSLDYWGQGTLVTVSSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4912 - protein, 214 aa, synthetic construct; identical to SEQ ID NO: 4858
  REGION 1..214: note = Us_VK-CK

SEQ ID NO: 4913 - protein, 226 aa, synthetic construct
  REGION 1..226: note = Us_VH-x-CK/N84S
EVQLVQSGAEVKKPGESLKISCKGSGYSFTTYWLGWVRQMPGKGLDWIGIMSPVDSDIRYSPSFQGQVTMSVDKSITTAYLQWSSLKASDTAMYYCARRRPGQGYFDFWGQGTLVTVSSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4914 - protein, 215 aa, synthetic construct; identical to SEQ ID NO: 4859
  REGION 1..215: note = Se_VK-CK

SEQ ID NO: 4915 - protein, 234 aa, synthetic construct
  REGION 1..234: note = Se_VH-x-CK/N84S
EVQLVESGGGLVQPGGSLRLSCAASGFTFSNYWMNWVRQAPGKGLEWVAAINQDGSEKYYVGSVKGRFTISRDNAKNSLYLQMSSLRVEDTAVYYCVRDYYDILTDYYIHYWYFDLWGRGTLVTVSSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4916 - protein, 219 aa, synthetic construct; identical to SEQ ID NO: 4857
  REGION 1..219: note = Ve_VK-CK

SEQ ID NO: 4917 - protein, 228 aa, synthetic construct
  REGION 1..228: note = Ve_VH-x-CK
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGGYDGWDYAIDYWGQGTLVTVSSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4918 - protein, 221 aa, synthetic construct; identical to SEQ ID NO: 4828
  REGION 1..221: note = Fc6/knob

SEQ ID NO: 4919 - protein, 221 aa, synthetic construct
  REGION 1..221: note = Fc6/knob/LALA
CPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4920 - protein, 605 aa, synthetic construct
  REGION 1..605: note = Pe_VH-CH1/Q39K/S183E/CLD201/hole/PGLALA/RF
QVQLVQSGVEVKKPGASVKVSCKASGYTFTNYYMYWVRKAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4921 - protein, 439 aa, synthetic construct
  REGION 1..439: note = Ip_VK-x-CH1/Q38E/S183K/knob/PGLALA
EIVLTQSPGTLSLSPGERATLSCRASQSVGSSYLAWYQEKPGQAPRLLIYGAFSRATGIPDRFSGSGSGTDFTLTISRLEPEDFAVYYCQQYGSSPWTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4922 - protein, 439 aa, synthetic construct
  REGION 1..439: note = Ip_VK-x-CH1/Q38K/S183K/knob/PGLALA
EIVLTQSPGTLSLSPGERATLSCRASQSVGSSYLAWYQKKPGQAPRLLIYGAFSRATGIPDRFSGSGSGTDFTLTISRLEPEDFAVYYCQQYGSSPWTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4923 - protein, 605 aa, synthetic construct
  REGION 1..605: note = Pe_VH-CH1/Q39E/S183E/CLD201/hole/PGLALA/RF
QVQLVQSGVEVKKPGASVKVSCKASGYTFTNYYMYWVREAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4924 - protein, 439 aa, synthetic construct
  REGION 1..439: note = Ip_VK-x-CH1/Q38E/S183K/knob/PGLALA/RF
EIVLTQSPGTLSLSPGERATLSCRASQSVGSSYLAWYQEKPGQAPRLLIYGAFSRATGIPDRFSGSGSGTDFTLTISRLEPEDFAVYYCQQYGSSPWTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNRFTQKSLSLSPG

SEQ ID NO: 4925 - protein, 439 aa, synthetic construct
  REGION 1..439: note = Ip_VK-x-CH1/Q38K/S183K/knob/PGLALA/RF
EIVLTQSPGTLSLSPGERATLSCRASQSVGSSYLAWYQKKPGQAPRLLIYGAFSRATGIPDRFSGSGSGTDFTLTISRLEPEDFAVYYCQQYGSSPWTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNRFTQKSLSLSPG

SEQ ID NO: 4926 - protein, 603 aa, synthetic construct
  REGION 1..603: note = Ip_VH-CH1/N84S/Q39K/S183E/CLD201/hole/PGLALA/RF
QVQLVESGGGVVQPGRSLRLSCAASGFTFSSYTMHWVRKAPGKGLEWVTFISYDGNNKYYADSVKGRFTISRDNSKNTLYLQMSSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4927 - protein, 442 aa, synthetic construct
  REGION 1..442: note = Pe_VK-x-CH1/Q38E/S183K/knob/PGLALA
EIVLTQSPATLSLSPGERATLSCRASKGVSTSGYSYLHWYQEKPGQAPRLLIYLASYLESGVPARFSGSGSGTDFTLTISSLEPEDFAVYYCQHSRDLPLTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4928 - protein, 442 aa, synthetic construct
  REGION 1..442: note = Pe_VK-x-CH1/Q38K/S183K/knob/PGLALA
EIVLTQSPATLSLSPGERATLSCRASKGVSTSGYSYLHWYQKKPGQAPRLLIYLASYLESGVPARFSGSGSGTDFTLTISSLEPEDFAVYYCQHSRDLPLTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4929 - protein, 603 aa, synthetic construct
  REGION 1..603: note = Ip_VH-CH1/N84S/Q39E/S183E/CLD201/hole/PGLALA/RF
QVQLVESGGGVVQPGRSLRLSCAASGFTFSSYTMHWVREAPGKGLEWVTFISYDGNNKYYADSVKGRFTISRDNSKNTLYLQMSSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4930 - protein, 605 aa, synthetic construct
  REGION 1..605: note = 388D4-3_VH-CH1/Q39K/S183E/CLD201/hole/PGLALA/RF
EVQLVQSGAEVKKPGASVKVSCKASGYTFTDYEMHWVRKAPGQGLEWMGIIDPGTGGTAYNQKFQGRVTMTADKSTSTVYMELSSLRSEDTAVYYCTSEKFGSNYYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4931 - protein, 605 aa, synthetic construct
  REGION 1..605: note = 388D4-3_VH-CH1/Q39E/S183E/CLD201/hole/PGLALA/RF
EVQLVQSGAEVKKPGASVKVSCKASGYTFTDYEMHWVREAPGQGLEWMGIIDPGTGGTAYNQKFQGRVTMTADKSTSTVYMELSSLRSEDTAVYYCTSEKFGSNYYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4932 - protein, 443 aa, synthetic construct
  REGION 1..443: note = 388D4-3_VK-x-CH1/Q38E/S183K/knob/PGLALA
DIVMTQTPLSSPVTLGQPASISCRSSQTIVHSDGNTYLEWYQERPGQPPRLLIYKVSNRFSGVPDRFSGSGAGTDFTLKISRVEAEDVGVYYCFQGSHVPLTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4933 - protein, 443 aa, synthetic construct
  REGION 1..443: note = 388D4-3_VK-x-CH1/Q38K/S183K/knob/PGLALA
DIVMTQTPLSSPVTLGQPASISCRSSQTIVHSDGNTYLEWYQKRPGQPPRLLIYKVSNRFSGVPDRFSGSGAGTDFTLKISRVEAEDVGVYYCFQGSHVPLTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4934 - protein, 439 aa, synthetic construct
  REGION 1..439: note = 244C8-2_VK-x-CH1/Q38E/S183K/knob/PGLALA
DIVLTQSPGTLSLSPGEKVTLSCRASSSVSSNYLYWYQEKPGQAPRLVIYSTSNLATGIPDRFSGSGSGTDYTLTISRLEPEDFAVYFCHQWSSYPPTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4935 - protein, 439 aa, synthetic construct
  REGION 1..439: note = 244C8-2_VK-x-CH1/Q38K/S183K/knob/PGLALA
DIVLTQSPGTLSLSPGEKVTLSCRASSSVSSNYLYWYQKKPGQAPRLVIYSTSNLATGIPDRFSGSGSGTDYTLTISRLEPEDFAVYFCHQWSSYPPTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4936 - protein, 605 aa, synthetic construct
  REGION 1..605: note = 244C8-2_VH-CH1/Q39K/S183E/CLD201/hole/PGLALA/RF
QVQLVQSGAEVKKPGASVKVSCKASGYTFTSYWMHWVRKAPGQGLEWMGMIDPSNSETSLNQKFQGRVTMTVDKSTNTVYMELSSLRSEDTAVYYCARSRGNYAYEMDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4937 - protein, 605 aa, synthetic construct
  REGION 1..605: note = 244C8-2_VH-CH1/Q39E/S183E/CLD201/hole/PGLALA/RF
QVQLVQSGAEVKKPGASVKVSCKASGYTFTSYWMHWVREAPGQGLEWMGMIDPSNSETSLNQKFQGRVTMTVDKSTNTVYMELSSLRSEDTAVYYCARSRGNYAYEMDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4938 - protein, 218 aa, synthetic construct
  REGION 1..218: note = Pe_VK-CK/Q38E/V133K
EIVLTQSPATLSLSPGERATLSCRASKGVSTSGYSYLHWYQEKPGQAPRLLIYLASYLESGVPARFSGSGSGTDFTLTISSLEPEDFAVYYCQHSRDLPLTFGGGTKVEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 4939 - protein, 225 aa, synthetic construct
  REGION 1..225: note = Ip_VH-x-CK/N84S/Q39K/V133E
QVQLVESGGGVVQPGRSLRLSCAASGFTFSSYTMHWVRKAPGKGLEWVTFISYDGNNKYYADSVKGRFTISRDNSKNTLYLQMSSLRAEDTAIYYCARTGWLGPFDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 4940 - protein, 225 aa, synthetic construct
  REGION 1..225: note = Ip_VH-x-CK/N84S/Q39E/V133E
QVQLVESGGGVVQPGRSLRLSCAASGFTFSSYTMHWVREAPGKGLEWVTFISYDGNNKYYADSVKGRFTISRDNSKNTLYLQMSSLRAEDTAIYYCARTGWLGPFDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 4941 - protein, 218 aa, synthetic construct
  REGION 1..218: note = Pe_VK-CK/Q38K/V133K
EIVLTQSPATLSLSPGERATLSCRASKGVSTSGYSYLHWYQKKPGQAPRLLIYLASYLESGVPARFSGSGSGTDFTLTISSLEPEDFAVYYCQHSRDLPLTFGGGTKVEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 4942 - protein, 215 aa, synthetic construct
  REGION 1..215: note = Ip_VK-CK/Q38E/V133K
EIVLTQSPGTLSLSPGERATLSCRASQSVGSSYLAWYQEKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 4943 - protein, 227 aa, synthetic construct
  REGION 1..227: note = Pe_VH-x-CK/Q39K/V133E
QVQLVQSGVEVKKPGASVKVSCKASGYTFTNYYMYWVRKAPGQGLEWMGGINPSNGGTNFNEKFKNRVTLTTDSSTTTAYMELKSLQFDDTAVYYCARRDYRFDMGFDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 4944 - protein, 227 aa, synthetic construct
  REGION 1..227: note = Pe_VH-x-CK/Q39E/V133E
QVQLVQSGVEVKKPGASVKVSCKASGYTFTNYYMYWVREAPGQGLEWMGGINPSNGGTNFNEKFKNRVTLTTDSSTTTAYMELKSLQFDDTAVYYCARRDYRFDMGFDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 4945 - protein, 215 aa, synthetic construct
  REGION 1..215: note = Ip_VK-CK/Q38K/V133K
EIVLTQSPGTLSLSPGERATLSCRASQSVGSSYLAWYQKKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 4946 - protein, 219 aa, synthetic construct
  REGION 1..219: note = 388D4-3_VK-CK/Q38E/V133K
DIVMTQTPLSSPVTLGQPASISCRSSQTIVHSDGNTYLEWYQERPGQPPRLLIYKVSNRFSGVPDRFSGSGAGTDFTLKISRVEAEDVGVYYCFQGSHVPLTFGQGTKLEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 4947 - protein, 219 aa, synthetic construct
  REGION 1..219: note = 388D4-3_VK-CK/Q38K/V133K
DIVMTQTPLSSPVTLGQPASISCRSSQTIVHSDGNTYLEWYQKRPGQPPRLLIYKVSNRFSGVPDRFSGSGAGTDFTLKISRVEAEDVGVYYCFQGSHVPLTFGQGTKLEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 4948 - protein, 227 aa, synthetic construct
  REGION 1..227: note = 388D4-3_VH-x-CK/Q39K/V133E
EVQLVQSGAEVKKPGASVKVSCKASGYTFTDYEMHWVRKAPGQGLEWMGIIDPGTGGTAYNQKFQGRVTMTADKSTSTVYMELSSLRSEDTAVYYCTSEKFGSNYYFDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 4949 - protein, 227 aa, synthetic construct
  REGION 1..227: note = 388D4-3_VH-x-CK/Q39E/V133E
EVQLVQSGAEVKKPGASVKVSCKASGYTFTDYEMHWVREAPGQGLEWMGIIDPGTGGTAYNQKFQGRVTMTADKSTSTVYMELSSLRSEDTAVYYCTSEKFGSNYYFDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 4950 - protein, 227 aa, synthetic construct
  REGION 1..227: note = 244C8-2_VH-x-CK/Q39K/V133E
QVQLVQSGAEVKKPGASVKVSCKASGYTFTSYWMHWVRKAPGQGLEWMGMIDPSNSETSLNQKFQGRVTMTVDKSTNTVYMELSSLRSEDTAVYYCARSRGNYAYEMDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 4951 - protein, 227 aa, synthetic construct
  REGION 1..227: note = 244C8-2_VH-x-CK/Q39E/V133E
QVQLVQSGAEVKKPGASVKVSCKASGYTFTSYWMHWVREAPGQGLEWMGMIDPSNSETSLNQKFQGRVTMTVDKSTNTVYMELSSLRSEDTAVYYCARSRGNYAYEMDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 4952 - protein, 215 aa, synthetic construct
  REGION 1..215: note = 244C8-2_VK-CK/Q38E/V133K
DIVLTQSPGTLSLSPGEKVTLSCRASSSVSSNYLYWYQEKPGQAPRLVIYSTSNLATGIPDRFSGSGSGTDYTLTISRLEPEDFAVYFCHQWSSYPPTFGQGTKVEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 4953 - protein, 215 aa, synthetic construct
  REGION 1..215: note = 244C8-2_VK-CK/Q38K/V133K
DIVLTQSPGTLSLSPGEKVTLSCRASSSVSSNYLYWYQKKPGQAPRLVIYSTSNLATGIPDRFSGSGSGTDYTLTISRLEPEDFAVYFCHQWSSYPPTFGQGTKVEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 4954 - protein, 221 aa, synthetic construct; identical to SEQ ID NO: 706
  REGION 1..221: note = Fc6/knob/PGLALA

SEQ ID NO: 4955 - protein, 605 aa, synthetic construct; identical to SEQ ID NO: 4920
  REGION 1..605: note = Pe_VH-CH1/Q39K/S183E/CLD201/hole/PGLALA

SEQ ID NO: 4956 - protein, 438 aa, synthetic construct
  REGION 1..438: note = At_VK-x-CH1/Q38E/S183K/knob/PGLALA
DIQMTQSPSSLSASVGDRVTITCRASQDVSTAVAWYQEKPGKAPKLLIYSASFLYSGVPSRFSGSGSGTDFTLTISSLQPEDFATYYCQQYLYHPATFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4957 - protein, 438 aa, synthetic construct
  REGION 1..438: note = At_VK-x-CH1/Q38K/S183K/knob/PGLALA
DIQMTQSPSSLSASVGDRVTITCRASQDVSTAVAWYQKKPGKAPKLLIYSASFLYSGVPSRFSGSGSGTDFTLTISSLQPEDFATYYCQQYLYHPATFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4958 - protein, 605 aa, synthetic construct; identical to SEQ ID NO: 4923
  REGION 1..605: note = Pe_VH-CH1/Q39E/S183E/CLD201/hole/PGLALA/RF

SEQ ID NO: 4959 - protein, 603 aa, synthetic construct
  REGION 1..603: note = At_VH-CH1/N84S/Q39K/S183E/CLD201/hole/PGLALA/RF
EVQLVESGGGLVQPGGSLRLSCAASGFTFSDSWIHWVRKAPGKGLEWVAWISPYGGSTYYADSVKGRFTISADTSKNTAYLQMSSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4960 - protein, 442 aa, synthetic construct; identical to SEQ ID NO: 4927
  REGION 1..442: note = Pe_VK-x-CH1/Q38E/S183K/knob/PGLALA

SEQ ID NO: 4961 - protein, 442 aa, synthetic construct; identical to SEQ ID NO: 4928
  REGION 1..442: note = Pe_VK-x-CH1/Q38K/S183K/knob/PGLALA

SEQ ID NO: 4962 - protein, 603 aa, synthetic construct
  REGION 1..603: note = At_VH-CH1/N84S/Q39E/S183E/CLD201/hole/PGLALA/RF
EVQLVESGGGLVQPGGSLRLSCAASGFTFSDSWIHWVREAPGKGLEWVAWISPYGGSTYYADSVKGRFTISADTSKNTAYLQMSSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4963 - protein, 605 aa, synthetic construct; identical to SEQ ID NO: 4930
  REGION 1..605: note = 388D4-3_VH-CH1/Q39K/S183E/CLD201/hole/PGLALA/RF

SEQ ID NO: 4964 - protein, 605 aa, synthetic construct; identical to SEQ ID NO: 4931
  REGION 1..605: note = 388D4-3_VH-CH1/Q39E/S183E/CLD201/hole/PGLALA/RF

SEQ ID NO: 4965 - protein, 443 aa, synthetic construct; identical to SEQ ID NO: 4932
  REGION 1..443: note = 388D4-3_VK-x-CH1/Q38E/S183K/knob/PGLALA

SEQ ID NO: 4966 - protein, 443 aa, synthetic construct; identical to SEQ ID NO: 4933
  REGION 1..443: note = 388D4-3_VK-x-CH1/Q38K/S183K/knob/PGLALA

SEQ ID NO: 4967 - protein, 438 aa, synthetic construct
  REGION 1..438: note = B60-55_VK-x-CH1/Q38E/S183K/knob/PGLALA
EIVMTQSPATLSLSPGERATLSCRASQSVGIHLAWYQEKLGQAPRLLIYGASSRATGIPDRFSGSGSGTDFTLTISRLEPEDFAVYYCQQYGSLPRTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4968 - protein, 438 aa, synthetic construct
  REGION 1..438: note = B60-55_VK-x-CH1/Q38K/S183K/knob/PGLALA
EIVMTQSPATLSLSPGERATLSCRASQSVGIHLAWYQKKLGQAPRLLIYGASSRATGIPDRFSGSGSGTDFTLTISRLEPEDFAVYYCQQYGSLPRTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4969 - protein, 605 aa, synthetic construct
  REGION 1..605: note = B60-55_VH-CH1/Q39K/S183E/CLD201/hole/PGLALA/RF
QVQLVQSGAEVKKPASSVKVSCTASGGSFSTYAISWVRKAPGQGLEWMGGIIPIFGTTKYAQRFQGRVTITADESTTTAYMELSSLISDDTALYYCTTSRGFNYGWFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4970 - protein, 605 aa, synthetic construct
  REGION 1..605: note = B60-55_VH-CH1/Q39E/S183E/CLD201/hole/PGLALA/RF
QVQLVQSGAEVKKPASSVKVSCTASGGSFSTYAISWVREAPGQGLEWMGGIIPIFGTTKYAQRFQGRVTITADESTTTAYMELSSLISDDTALYYCTTSRGFNYGWFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4971 - protein, 218 aa, synthetic construct; identical to SEQ ID NO: 4938
  REGION 1..218: note = Pe_VK-CK/Q38E/V133K

SEQ ID NO: 4972 - protein, 225 aa, synthetic construct
  REGION 1..225: note = At_VH-x-CK/N84S/Q39K/V133E
EVQLVESGGGLVQPGGSLRLSCAASGFTFSDSWIHWVRKAPGKGLEWVAWISPYGGSTYYADSVKGRFTISADTSKNTAYLQMSSLRAEDTAVYYCARRHWPGGFDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 4973 - protein, 225 aa, synthetic construct
  REGION 1..225: note = At_VH-x-CK/N84S/Q39E/V133E
EVQLVESGGGLVQPGGSLRLSCAASGFTFSDSWIHWVREAPGKGLEWVAWISPYGGSTYYADSVKGRFTISADTSKNTAYLQMSSLRAEDTAVYYCARRHWPGGFDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 4974 - protein, 218 aa, synthetic construct; identical to SEQ ID NO: 4941
  REGION 1..218: note = Pe_VK-CK/Q38K/V133K

SEQ ID NO: 4975 - protein, 214 aa, synthetic construct
  REGION 1..214: note = At_VK-CK/Q38E/V133K
DIQMTQSPSSLSASVGDRVTITCRASQDVSTAVAWYQEKPGKAPKLLIYSASFLYSGVPSRFSGSGSGTDFTLTISSLQPEDFATYYCQQYLYHPATFGQGTKVEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 4976 - protein, 227 aa, synthetic construct; identical to SEQ ID NO: 4943
  REGION 1..227: note = Pe_VH-x-CK/Q39K/V133E

SEQ ID NO: 4977 - protein, 227 aa, synthetic construct; identical to SEQ ID NO: 4944
  REGION 1..227: note = Pe_VH-x-CK/Q39E/V133E

SEQ ID NO: 4978 - protein, 214 aa, synthetic construct
  REGION 1..214: note = At_VK-CK/Q38K/V133K
DIQMTQSPSSLSASVGDRVTITCRASQDVSTAVAWYQKKPGKAPKLLIYSASFLYSGVPSRFSGSGSGTDFTLTISSLQPEDFATYYCQQYLYHPATFGQGTKVEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 4979 - protein, 219 aa, synthetic construct; identical to SEQ ID NO: 4946
  REGION 1..219: note = 388D4-3_VK-CK/Q38E/V133K

SEQ ID NO: 4980 - protein, 219 aa, synthetic construct; identical to SEQ ID NO: 4947
  REGION 1..219: note = 388D4-3_VK-CK/Q38K/V133K

SEQ ID NO: 4981 - protein, 227 aa, synthetic construct; identical to SEQ ID NO: 4948
  REGION 1..227: note = 388D4-3_VH-x-CK/Q39K/V133E

SEQ ID NO: 4982 - protein, 227 aa, synthetic construct; identical to SEQ ID NO: 4949
  REGION 1..227: note = 388D4-3_VH-x-CK/Q39E/V133E

SEQ ID NO: 4983 - protein, 227 aa, synthetic construct
  REGION 1..227: note = B60-55_VH-x-CK/Q39K/V133E
QVQLVQSGAEVKKPASSVKVSCTASGGSFSTYAISWVRKAPGQGLEWMGGIIPIFGTTKYAQRFQGRVTITADESTTTAYMELSSLISDDTALYYCTTSRGFNYGWFDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 4984 - protein, 227 aa, synthetic construct
  REGION 1..227: note = B60-55_VH-x-CK/Q39E/V133E
QVQLVQSGAEVKKPASSVKVSCTASGGSFSTYAISWVREAPGQGLEWMGGIIPIFGTTKYAQRFQGRVTITADESTTTAYMELSSLISDDTALYYCTTSRGFNYGWFDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 4985 - protein, 214 aa, synthetic construct
  REGION 1..214: note = B60-55_VK-CK/Q38E/V133K
EIVMTQSPATLSLSPGERATLSCRASQSVGIHLAWYQEKLGQAPRLLIYGASSRATGIPDRFSGSGSGTDFTLTISRLEPEDFAVYYCQQYGSLPRTFGQGTKVEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 4986 - protein, 214 aa, synthetic construct
  REGION 1..214: note = B60-55_VK-CK/Q38K/V133K
EIVMTQSPATLSLSPGERATLSCRASQSVGIHLAWYQKKLGQAPRLLIYGASSRATGIPDRFSGSGSGTDFTLTISRLEPEDFAVYYCQQYGSLPRTFGQGTKVEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 4987 - protein, 605 aa, synthetic construct
  REGION 1..605: note = Tr_VH-CH1/N84S/Q39K/S183E/CLD201/hole/RF
EVQLVESGGGLVQPGGSLRLSCAASGFNIKDTYIHWVRKAPGKGLEWVARIYPTNGYTRYADSVKGRFTISADTSKNTAYLQMSSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4988 - protein, 438 aa, synthetic construct
  REGION 1..438: note = Pt_VK-x-CH1/Q38E/S183K/knob
DIQMTQSPSSLSASVGDRVTITCKASQDVSIGVAWYQEKPGKAPKLLIYSASYRYTGVPSRFSGSGSGTDFTLTISSLQPEDFATYYCQQYYIYPYTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4989 - protein, 438 aa, synthetic construct
  REGION 1..438: note = Pt_VK-x-CH1/Q38K/S183K/knob
DIQMTQSPSSLSASVGDRVTITCKASQDVSIGVAWYQKKPGKAPKLLIYSASYRYTGVPSRFSGSGSGTDFTLTISSLQPEDFATYYCQQYYIYPYTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4990 - protein, 605 aa, synthetic construct
  REGION 1..605: note = Tr_VH-CH1/N84S/Q39E/S183E/CLD201/hole/RF
EVQLVESGGGLVQPGGSLRLSCAASGFNIKDTYIHWVREAPGKGLEWVARIYPTNGYTRYADSVKGRFTISADTSKNTAYLQMSSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4991 - protein, 604 aa, synthetic construct
  REGION 1..604: note = Pt_VH-CH1/N84S/Q39K/S183E/CLD201/hole/RF
EVQLVESGGGLVQPGGSLRLSCAASGFTFTDYTMDWVRKAPGKGLEWVADVNPNSGGSIYNQRFKGRFTLSVDRSKNTLYLQMSSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4992 - protein, 438 aa, synthetic construct
  REGION 1..438: note = Tr_VK-x-CH1/Q38E/S183K/knob
DIQMTQSPSSLSASVGDRVTITCRASQDVNTAVAWYQEKPGKAPKLLIYSASFLYSGVPSRFSGSRSGTDFTLTISSLQPEDFATYYCQQHYTTPPTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4993 - protein, 438 aa, synthetic construct
  REGION 1..438: note = Tr_VK-x-CH1/Q38K/S183K/knob
DIQMTQSPSSLSASVGDRVTITCRASQDVNTAVAWYQKKPGKAPKLLIYSASFLYSGVPSRFSGSRSGTDFTLTISSLQPEDFATYYCQQHYTTPPTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4994 - protein, 604 aa, synthetic construct
  REGION 1..604: note = Pt_VH-CH1/N84S/Q39E/S183E/CLD201/hole/RF
EVQLVESGGGLVQPGGSLRLSCAASGFTFTDYTMDWVREAPGKGLEWVADVNPNSGGSIYNQRFKGRFTLSVDRSKNTLYLQMSSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4995 - protein, 604 aa, synthetic construct
  REGION 1..604: note = Ce_VH-CH1/N84S/Q39K/S183E/CLD201/hole/RF
QVQLKQSGPGLVQPSQSLSITCTVSGFSLTNYGVHWVRKSPGKGLEWLGVIWSGGNTDYNTPFTSRLSINKDNSKSQVFFKMSSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4996 - protein, 604 aa, synthetic construct
  REGION 1..604: note = Ce_VH-CH1/N84S/Q39E/S183E/CLD201/hole/RF
QVQLKQSGPGLVQPSQSLSITCTVSGFSLTNYGVHWVRESPGKGLEWLGVIWSGGNTDYNTPFTSRLSINKDNSKSQVFFKMSSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 4997 - protein, 438 aa, synthetic construct
  REGION 1..438: note = Ce_VK-x-CH1/Q38E/S183K/knob
DILLTQSPVILSVSPGERVSFSCRASQSIGTNIHWYQERTNGSPRLLIKYASESISGIPSRFSGSGSGTDFTLSINSVESEDIADYYCQQNNNWPTTFGAGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4998 - protein, 438 aa, synthetic construct
  REGION 1..438: note = Ce_VK-x-CH1/Q38K/S183K/knob
DILLTQSPVILSVSPGERVSFSCRASQSIGTNIHWYQKRTNGSPRLLIKYASESISGIPSRFSGSGSGTDFTLSINSVESEDIADYYCQQNNNWPTTFGAGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 4999 - protein, 605 aa, synthetic construct
  REGION 1..605: note = Tr_VH-CH1/N84S/Q39K/S183E/CLD201/hole/PGLALA/RF
EVQLVESGGGLVQPGGSLRLSCAASGFNIKDTYIHWVRKAPGKGLEWVARIYPTNGYTRYADSVKGRFTISADTSKNTAYLQMSSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 5000 - protein, 443 aa, synthetic construct; identical to SEQ ID NO: 4932
  REGION 1..443: note = 388D4-3_VK-x-CH1/Q38E/S183K/knob/PGLALA

SEQ ID NO: 5001 - protein, 443 aa, synthetic construct; identical to SEQ ID NO: 4933
  REGION 1..443: note = 388D4-3_VK-x-CH1/Q38K/S183K/knob/PGLALA

SEQ ID NO: 5002 - protein, 605 aa, synthetic construct
  REGION 1..605: note = Tr_VH-CH1/N84S/Q39E/S183E/CLD201/hole/PGLALA/RF
EVQLVESGGGLVQPGGSLRLSCAASGFNIKDTYIHWVREAPGKGLEWVARIYPTNGYTRYADSVKGRFTISADTSKNTAYLQMSSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 5003 - protein, 605 aa, synthetic construct; identical to SEQ ID NO: 4930
  REGION 1..605: note = 388D4-3_VH-CH1/Q39K/S183E/CLD201/hole/PGLALA/RF

SEQ ID NO: 5004 - protein, 438 aa, synthetic construct
  REGION 1..438: note = Tr_VK-x-CH1/Q38E/S183K/knob/PGLALA
DIQMTQSPSSLSASVGDRVTITCRASQDVNTAVAWYQEKPGKAPKLLIYSASFLYSGVPSRFSGSRSGTDFTLTISSLQPEDFATYYCQQHYTTPPTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 5005 - protein, 438 aa, synthetic construct
  REGION 1..438: note = Tr_VK-x-CH1/Q38K/S183K/knob/PGLALA
DIQMTQSPSSLSASVGDRVTITCRASQDVNTAVAWYQKKPGKAPKLLIYSASFLYSGVPSRFSGSRSGTDFTLTISSLQPEDFATYYCQQHYTTPPTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 5006 - protein, 605 aa, synthetic construct; identical to SEQ ID NO: 4931
  REGION 1..605: note = 388D4-3_VH-CH1/Q39E/S183E/CLD201/hole/PGLALA/RF

SEQ ID NO: 5007 - protein, 604 aa, synthetic construct
  REGION 1..604: note = Ce_VH-CH1/N84S/Q39K/S183E/CLD201/hole/PGLALA/RF
QVQLKQSGPGLVQPSQSLSITCTVSGFSLTNYGVHWVRKSPGKGLEWLGVIWSGGNTDYNTPFTSRLSINKDNSKSQVFFKMSSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 5008 - protein, 604 aa, synthetic construct
  REGION 1..604: note = Ce_VH-CH1/N84S/Q39E/S183E/CLD201/hole/PGLALA/RF
QVQLKQSGPGLVQPSQSLSITCTVSGFSLTNYGVHWVRESPGKGLEWLGVIWSGGNTDYNTPFTSRLSINKDNSKSQVFFKMSSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 5009 - protein, 438 aa, synthetic construct
  REGION 1..438: note = Ce_VK-x-CH1/Q38E/S183K/knob/PGLALA
DILLTQSPVILSVSPGERVSFSCRASQSIGTNIHWYQERTNGSPRLLIKYASESISGIPSRFSGSGSGTDFTLSINSVESEDIADYYCQQNNNWPTTFGAGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 5010 - protein, 438 aa, synthetic construct
  REGION 1..438: note = Ce_VK-x-CH1/Q38K/S183K/knob/PGLALA
DILLTQSPVILSVSPGERVSFSCRASQSIGTNIHWYQKRTNGSPRLLIKYASESISGIPSRFSGSGSGTDFTLSINSVESEDIADYYCQQNNNWPTTFGAGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 5011 - protein, 438 aa, synthetic construct; identical to SEQ ID NO: 4967
  REGION 1..438: note = B60-55_VK-x-CH1/Q38E/S183K/knob/PGLALA

SEQ ID NO: 5012 - protein, 438 aa, synthetic construct; identical to SEQ ID NO: 4968
  REGION 1..438: note = B60-55_VK-x-CH1/Q38K/S183K/knob/PGLALA

SEQ ID NO: 5013 - protein, 605 aa, synthetic construct; identical to SEQ ID NO: 4969
  REGION 1..605: note = B60-55_VH-CH1/Q39K/S183E/CLD201/hole/PGLALA/RF

SEQ ID NO: 5014 - protein, 605 aa, synthetic construct; identical to SEQ ID NO: 4970
  REGION 1..605: note = B60-55_VH-CH1/Q39E/S183E/CLD201/hole/PGLALA/RF

SEQ ID NO: 5015 - protein, 214 aa, synthetic construct
  REGION 1..214: note = Tr_VK-CK/Q38E/V133K
DIQMTQSPSSLSASVGDRVTITCRASQDVNTAVAWYQEKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 5016 - protein, 226 aa, synthetic construct
  REGION 1..226: note = Pt_VH-x-CK/N84S/Q39K/V133E
EVQLVESGGGLVQPGGSLRLSCAASGFTFTDYTMDWVRKAPGKGLEWVADVNPNSGGSIYNQRFKGRFTLSVDRSKNTLYLQMSSLRAEDTAVYYCARNLGPSFYFDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 5017 - protein, 226 aa, synthetic construct
  REGION 1..226: note = Pt_VH-x-CK/N84S/Q39E/V133E
EVQLVESGGGLVQPGGSLRLSCAASGFTFTDYTMDWVREAPGKGLEWVADVNPNSGGSIYNQRFKGRFTLSVDRSKNTLYLQMSSLRAEDTAVYYCARNLGPSFYFDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 5018 - protein, 214 aa, synthetic construct
  REGION 1..214: note = Tr_VK-CK/Q38K/V133K
DIQMTQSPSSLSASVGDRVTITCRASQDVNTAVAWYQKKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 5019 - protein, 214 aa, synthetic construct
  REGION 1..214: note = Pt_VK-CK/Q38E/V133K
DIQMTQSPSSLSASVGDRVTITCKASQDVSIGVAWYQEKPGKAPKLLIYSASYRYTGVPSRFSGSGSGTDFTLTISSLQPEDFATYYCQQYYIYPYTFGQGTKVEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 5020 - protein, 227 aa, synthetic construct
  REGION 1..227: note = Tr_VH-x-CK/N84S/Q39K/V133E
EVQLVESGGGLVQPGGSLRLSCAASGFNIKDTYIHWVRKAPGKGLEWVARIYPTNGYTRYADSVKGRFTISADTSKNTAYLQMSSLRAEDTAVYYCSRWGGDGFYAMDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 5021 - protein, 227 aa, synthetic construct
  REGION 1..227: note = Tr_VH-x-CK/N84S/Q39E/V133E
EVQLVESGGGLVQPGGSLRLSCAASGFNIKDTYIHWVREAPGKGLEWVARIYPTNGYTRYADSVKGRFTISADTSKNTAYLQMSSLRAEDTAVYYCSRWGGDGFYAMDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 5022 - protein, 214 aa, synthetic construct
  REGION 1..214: note = Pt_VK-CK/Q38K/V133K
DIQMTQSPSSLSASVGDRVTITCKASQDVSIGVAWYQKKPGKAPKLLIYSASYRYTGVPSRFSGSGSGTDFTLTISSLQPEDFATYYCQQYYIYPYTFGQGTKVEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 5023 - protein, 214 aa, synthetic construct
  REGION 1..214: note = Ce_VK-CK/Q38E/V133K
DILLTQSPVILSVSPGERVSFSCRASQSIGTNIHWYQERTNGSPRLLIKYASESISGIPSRFSGSGSGTDFTLSINSVESEDIADYYCQQNNNWPTTFGAGTKLELKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 5024 - protein, 214 aa, synthetic construct
  REGION 1..214: note = Ce _VK-CK/Q38K/V133K
DILLTQSPVILSVSPGERVSFSCRASQSIGTNIHWYQKRTNGSPRLLIKYASESISGIPSRFSGSGSGTDFTLSINSVESEDIADYYCQQNNNWPTTFGAGTKLELKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 5025 - protein, 226 aa, synthetic construct
  REGION 1..226: note = Ce_VH-x-CK/N84S/Q39K/V133E
QVQLKQSGPGLVQPSQSLSITCTVSGFSLTNYGVHWVRKSPGKGLEWLGVIWSGGNTDYNTPFTSRLSINKDNSKSQVFFKMSSLQSNDTAIYYCARALTYYDYEFAYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 5026 - protein, 226 aa, synthetic construct
  REGION 1..226: note = Ce_VH-x-CK/N84S/Q39E/V133E
QVQLKQSGPGLVQPSQSLSITCTVSGFSLTNYGVHWVRESPGKGLEWLGVIWSGGNTDYNTPFTSRLSINKDNSKSQVFFKMSSLQSNDTAIYYCARALTYYDYEFAYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 5027 - protein, 227 aa, synthetic construct; identical to SEQ ID NO: 4948
  REGION 1..227: note = 388D4-3_VH-x-CK/Q39K/V133E

SEQ ID NO: 5028 - protein, 227 aa, synthetic construct; identical to SEQ ID NO: 4949
  REGION 1..227: note = 388D4-3_VH-x-CK/Q39E/V133E

SEQ ID NO: 5029 - protein, 219 aa, synthetic construct; identical to SEQ ID NO: 4946
  REGION 1..219: note = 388D4-3_VK-CK/Q38E/V133K

SEQ ID NO: 5030 - protein, 219 aa, synthetic construct; identical to SEQ ID NO: 4947
  REGION 1..219: note = 388D4-3_VK-CK/Q38K/V133K

SEQ ID NO: 5031 - protein, 227 aa, synthetic construct; identical to SEQ ID NO: 4983
  REGION 1..227: note = B60-55_VH-x-CK/Q39K/V133E

SEQ ID NO: 5032 - protein, 227 aa, synthetic construct; identical to SEQ ID NO: 4984
  REGION 1..227: note = B60-55_VH-x-CK/Q39E/V133E

SEQ ID NO: 5033 - protein, 214 aa, synthetic construct; identical to SEQ ID NO: 4985
  REGION 1..214: note = B60-55_VK-CK/Q38E/V133K

SEQ ID NO: 5034 - protein, 214 aa, synthetic construct; identical to SEQ ID NO: 4986
  REGION 1..214: note = B60-55_VK-CK/Q38K/V133K

SEQ ID NO: 5035 - protein, 1185 aa, synthetic construct
  REGION 1..1185: note = R_VH-CH1/Q39K/S183E/CLD201/hole/PGLALA/RF/41BBL
QVQLQQPGAELVKPGASVKMSCKASGYTFTSYNMHWVKKTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 5036 - protein, 440 aa, synthetic construct; identical to SEQ ID NO: 661
  REGION 1..440: note = Sp34_VK-CH1/knob/Q38E/S183K/PGLALA/RF

SEQ ID NO: 5037 - protein, 440 aa, synthetic construct; identical to SEQ ID NO: 662
  REGION 1..440: note = Sp34_VK-CH1/knob/Q38K/S183K/PGLALA/RF

SEQ ID NO: 5038 - protein, 606 aa, synthetic construct; identical to SEQ ID NO: 725
  REGION 1..606: note = R_VH-CH1/Q39K/S183E/CLD201/hole/PGLALA/RF

SEQ ID NO: 5039 - protein, 1019 aa, synthetic construct
  REGION 1..1019: note = Sp34_VK-CH1/knob/Q38E/S183K/PGLALA/RF/41BBL
QAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNRFTQKSLSLSPGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 5040 - protein, 1019 aa, synthetic construct
  REGION 1..1019: note = Sp34_VK-CH1/knob/Q38K/S183K/PGLALA/RF/41BBL
QAVVTQEPSLTVSPGGTVTLTCGSSTGAVTTSNYANWVQKKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNRFTQKSLSLSPGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 5041 - protein, 594 aa, synthetic construct; identical to SEQ ID NO: 4666
  REGION 1..594: note = R_VH-CH1/Q39K/S183E/CLD201/Sp34_VK-CH1/Q38E/S183K

SEQ ID NO: 5042 - protein, 594 aa, synthetic construct; identical to SEQ ID NO: 4667
  REGION 1..594: note = R_VH-CH1/Q39K/S183E/CLD201/Sp34_VK-CH1/Q38K/S183K

SEQ ID NO: 5043 - protein, 1173 aa, synthetic construct
  REGION 1..1173: note R_VH-CH1/Q39K/S183E/CLD201/Sp34_VK-CH1/Q38E/S183K/41BBL
QVQLQQPGAELVKPGASVKMSCKASGYTFTSYNMHWVKKTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRQAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 5044 - protein, 1173 aa, synthetic construct
  REGION 1..1173: note R_VH-CH1/Q39K/S183E/CLD201/Sp34_VK-CH1/Q38K/S183K/41BBL
QVQLQQPGAELVKPGASVKMSCKASGYTFTSYNMHWVKKTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRQAVVTQEPSLTVSPGGTVTLTCGSSTGAVTTSNYANWVQKKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 5045 - protein, 440 aa, synthetic construct; identical to SEQ ID NO: 658
  REGION 1..440: note = Sp34_VK-CH1/knob/Q38E/S183K/PGLALA

SEQ ID NO: 5046 - protein, 440 aa, synthetic construct; identical to SEQ ID NO: 659
  REGION 1..440: note = Sp34_VK-CH1/knob/Q38K/S183K/PGLALA

SEQ ID NO: 5047 - protein, 1019 aa, synthetic construct
  REGION 1..1019: note = Sp34_VK-CH1/knob/Q38E/S183K/PGLALA/41BBL
QAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 5048 - protein, 1019 aa, synthetic construct
  REGION 1..1019: note = Sp34_VK-CH1/knob/Q38K/S183K/PGLALA/41BBL
QAVVTQEPSLTVSPGGTVTLTCGSSTGAVTTSNYANWVQKKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 5049 - protein, 1184 aa, synthetic construct
  REGION 1..1184: note = Tr_VH-CH1/N84S/Q39K/S183E/CLD201/hole/PGLALA/RF/41BBL
EVQLVESGGGLVQPGGSLRLSCAASGFNIKDTYIHWVRKAPGKGLEWVARIYPTNGYTRYADSVKGRFTISADTSKNTAYLQMSSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 5050 - protein, 605 aa, synthetic construct; identical to SEQ ID NO: 4999
  REGION 1..605: note = Tr_VH-CH1/N84S/Q39K/S183E/CLD201/hole/PGLALA/RF

SEQ ID NO: 5051 - protein, 593 aa, synthetic construct
  REGION 1..593: note Tr_VH-CH1/N84S/Q39K/S183E/CLD201/Sp34_VK-CH1/Q38E/S183K
EVQLVESGGGLVQPGGSLRLSCAASGFNIKDTYIHWVRKAPGKGLEWVARIYPTNGYTRYADSVKGRFTISADTSKNTAYLQMSSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRQAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSC

SEQ ID NO: 5052 - protein, 593 aa, synthetic construct
  REGION 1..593: note Tr_VH-CH1/N84S/Q39K/S183E/CLD201/Sp34_VK-CH1/Q38K/S183K
EVQLVESGGGLVQPGGSLRLSCAASGFNIKDTYIHWVRKAPGKGLEWVARIYPTNGYTRYADSVKGRFTISADTSKNTAYLQMSSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRQAVVTQEPSLTVSPGGTVTLTCGSSTGAVTTSNYANWVQKKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSC

SEQ ID NO: 5053 - protein, 1172 aa, synthetic construct
  REGION 1..1172: note Tr_VH-CH1/N84S/Q39K/S183E/CLD201/Sp34_VK-CH1/Q38E/S183K/41B BL
EVQLVESGGGLVQPGGSLRLSCAASGFNIKDTYIHWVRKAPGKGLEWVARIYPTNGYTRYADSVKGRFTISADTSKNTAYLQMSSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRQAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 5054 - protein, 1172 aa, synthetic construct
  REGION 1..1172: note Tr_VH-CH1/N84S/Q39K/S183E/CLD201/Sp34_VK-CH1/Q38K/S183K/41B BL
EVQLVESGGGLVQPGGSLRLSCAASGFNIKDTYIHWVRKAPGKGLEWVARIYPTNGYTRYADSVKGRFTISADTSKNTAYLQMSSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRQAVVTQEPSLTVSPGGTVTLTCGSSTGAVTTSNYANWVQKKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 5055 - protein, 1185 aa, synthetic construct
  REGION 1..1185: note = Cg_VH-CH1/Q39K/S183E/CLD201/hole/PGLALA/RF/41BBL
QVQLVQSGAEVKKPGASVKVSCKASGYTFTEFGMNWVRKAPGQGLEWMGWINTKTGEATYVEEFKGRVTFTTDTSTSTAYMELRSLRSDDTAVYYCARWDFAYYVEAMDYWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 5056 - protein, 606 aa, synthetic construct
  REGION 1..606: note = Cg_VH-CH1/Q39K/S183E/CLD201/hole/PGLALA/RF
QVQLVQSGAEVKKPGASVKVSCKASGYTFTEFGMNWVRKAPGQGLEWMGWINTKTGEATYVEEFKGRVTFTTDTSTSTAYMELRSLRSDDTAVYYCARWDFAYYVEAMDYWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 5057 - protein, 594 aa, synthetic construct
  REGION 1..594: note = Cg_VH-CH1/Q39K/S183E/CLD201/Sp34_VK-CH1/Q38E/S183K
QVQLVQSGAEVKKPGASVKVSCKASGYTFTEFGMNWVRKAPGQGLEWMGWINTKTGEATYVEEFKGRVTFTTDTSTSTAYMELRSLRSDDTAVYYCARWDFAYYVEAMDYWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRQAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSC

SEQ ID NO: 5058 - protein, 594 aa, synthetic construct
  REGION 1..594: note = Cg_VH-CH1/Q39K/S183E/CLD201/Sp34_VK-CH1/Q38K/S183K
QVQLVQSGAEVKKPGASVKVSCKASGYTFTEFGMNWVRKAPGQGLEWMGWINTKTGEATYVEEFKGRVTFTTDTSTSTAYMELRSLRSDDTAVYYCARWDFAYYVEAMDYWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRQAVVTQEPSLTVSPGGTVTLTCGSSTGAVTTSNYANWVQKKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSC

SEQ ID NO: 5059 - protein, 1173 aa, synthetic construct
  REGION 1..1173: note Cg_VH-CH1/Q39K/S183E/CLD201/Sp34_VK-CH1/Q38E/S183K/41BBL
QVQLVQSGAEVKKPGASVKVSCKASGYTFTEFGMNWVRKAPGQGLEWMGWINTKTGEATYVEEFKGRVTFTTDTSTSTAYMELRSLRSDDTAVYYCARWDFAYYVEAMDYWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRQAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 5060 - protein, 1173 aa, synthetic construct
  REGION 1..1173: note Cg_VH-CH1/Q39K/S183E/CLD201/Sp34_VK-CH1/Q38K/S183K/41BBL
QVQLVQSGAEVKKPGASVKVSCKASGYTFTEFGMNWVRKAPGQGLEWMGWINTKTGEATYVEEFKGRVTFTTDTSTSTAYMELRSLRSDDTAVYYCARWDFAYYVEAMDYWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRQAVVTQEPSLTVSPGGTVTLTCGSSTGAVTTSNYANWVQKKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 5061 - protein, 213 aa, synthetic construct; identical to SEQ ID NO: 735
  REGION 1..213: note = R_VK-CK/Q38E/V133K

SEQ ID NO: 5062 - protein, 232 aa, synthetic construct; identical to SEQ ID NO: 698
  REGION 1..232: note = Sp34_VH-CK/N84S/Q39K/V133E

SEQ ID NO: 5063 - protein, 232 aa, synthetic construct; identical to SEQ ID NO: 699
  REGION 1..232: note = Sp34_VH-CK/N84S/Q39E/V133E

SEQ ID NO: 5064 - protein, 811 aa, synthetic construct
  REGION 1..811: note = Sp34_VH-CK/N84S/Q39K/V133E/41BBL
EVQLLESGGGLVQPGGSLRLSCAASGFTFSTYAMNWVRKAPGKGLEWVSRIRSKYNNYATYYADSVKGRFTISRDDSKNTLYLQMSSLRAEDTAVYYCVRHGNFGNSYVSWFAYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGECGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 5065 - protein, 811 aa, synthetic construct
  REGION 1..811: note = Sp34_VH-CK/N84S/Q39E/V133E/41BBL
EVQLLESGGGLVQPGGSLRLSCAASGFTFSTYAMNWVREAPGKGLEWVSRIRSKYNNYATYYADSVKGRFTISRDDSKNTLYLQMSSLRAEDTAVYYCVRHGNFGNSYVSWFAYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGECGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 5066 - protein, 214 aa, synthetic construct; identical to SEQ ID NO: 5015
  REGION 1..214: note = Tr_VK-CK/Q38E/V133K

SEQ ID NO: 5067 - protein, 215 aa, synthetic construct
  REGION 1..215: note = Cg_VK-CK/Q38E/V133K
DIQMTQSPSSLSASVGDRVTITCKASAAVGTYVAWYQEKPGKAPKLLIYSASYRKRGVPSRFSGSGSGTDFTLTISSLQPEDFATYYCHQYYTYPLFTFGQGTKLEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 5068 - protein, 221 aa, synthetic construct; identical to SEQ ID NO: 706
  REGION 1..221: note = Fc6/knob/PGLALA

SEQ ID NO: 5069 - protein, 800 aa, synthetic construct
  REGION 1..800: note = Fc6/knob/PGLALA/41BBL
CPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 5070 - protein, 500 aa, synthetic construct
  REGION 1..500: note = SIRPA/CLD201/hole/RF
EEELQVIQPDKSVSVAAGESAILHCTVTSLIPVGPIQWFRGAGPARELIYNQKEGHFPRVTTVSESTKRENMDFSISISNITPADAGTYYCVKFRKGSPDTEFKSGAGTELSVRAKPSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 5071 - protein, 523 aa, synthetic construct
  REGION 1..523: note = SIRPA201/CLD201/hole/RF
EEELQVIQPDKSVSVAAGESAILHCTVTSLIPVGPIQWFRGAGPARELIYNQKEGHFPRVTTVSESTKRENMDFSISISNITPADAGTYYCVKFRKGSPDTEFKSGAGTELSVRAKPSTSTSPTRSMAPGAVHLPQPVSTRTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 5072 - protein, 450 aa, synthetic construct; identical to SEQ ID NO: 4734
  REGION 1..450: note = R_VH-CH1/knob

SEQ ID NO: 5073 - protein, 451 aa, synthetic construct; identical to SEQ ID NO: 644
  REGION 1..451: note = Da_VH-CH1/N84S/knob

SEQ ID NO: 5074 - protein, 449 aa, synthetic construct
  REGION 1..449: note = Tr_VH-CH1/N84S/knob
EVQLVESGGGLVQPGGSLRLSCAASGFNIKDTYIHWVRQAPGKGLEWVARIYPTNGYTRYADSVKGRFTISADTSKNTAYLQMSSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 5075 - protein, 448 aa, synthetic construct
  REGION 1..448: note = Ce_VH-CH1/N84S/knob
QVQLKQSGPGLVQPSQSLSITCTVSGFSLTNYGVHWVRQSPGKGLEWLGVIWSGGNTDYNTPFTSRLSINKDNSKSQVFFKMSSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 5076 - protein, 450 aa, synthetic construct
  REGION 1..450: note = Cg_VH-CH1/N84S/knob
QVQLVQSGAEVKKPGASVKVSCKASGYTFTEFGMNWVRQAPGQGLEWMGWINTKTGEATYVEEFKGRVTFTTDTSTSTAYMELRSLRSDDTAVYYCARWDFAYYVEAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 5077 - protein, 977 aa, synthetic construct
  REGION 1..977: note = SIRPA/CLD201/hole/RF/CD40L
EEELQVIQPDKSVSVAAGESAILHCTVTSLIPVGPIQWFRGAGPARELIYNQKEGHFPRVTTVSESTKRENMDFSISISNITPADAGTYYCVKFRKGSPDTEFKSGAGTELSVRAKPSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGGGGSGGGGSEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKLGGGSGGGGSEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKLGGGSGGGGSEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 5078 - protein, 1000 aa, synthetic construct
  REGION 1..1000: note = SIRPA201/CLD201/hole/RF/CD40L
EEELQVIQPDKSVSVAAGESAILHCTVTSLIPVGPIQWFRGAGPARELIYNQKEGHFPRVTTVSESTKRENMDFSISISNITPADAGTYYCVKFRKGSPDTEFKSGAGTELSVRAKPSTSTSPTRSMAPGAVHLPQPVSTRTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGGGGSGGGGSEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKLGGGSGGGGSEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKLGGGSGGGGSEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 5079 - protein, 927 aa, synthetic construct
  REGION 1..927: note = R_VH-CH1/knob/CD40L
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGSGGGGSEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKLGGGSGGGGSEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKLGGGSGGGGSEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 5080 - protein, 928 aa, synthetic construct
  REGION 1..928: note = Da_VH-CH1/N84S/knob/CD40L
EVQLLESGGGLVQPGGSLRLSCAVSGFTFNSFAMSWVRQAPGKGLEWVSAISGSGGGTYYADSVKGRFTISRDNSKNTLYLQMSSLRAEDTAVYFCAKDKILWFGEPVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGSGGGGSEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKLGGGSGGGGSEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKLGGGSGGGGSEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 5081 - protein, 926 aa, synthetic construct
  REGION 1..926: note = Tr_VH-CH1/N84S/knob/CD40L
EVQLVESGGGLVQPGGSLRLSCAASGFNIKDTYIHWVRQAPGKGLEWVARIYPTNGYTRYADSVKGRFTISADTSKNTAYLQMSSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGSGGGGSEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKLGGGSGGGGSEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKLGGGSGGGGSEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 5082 - protein, 925 aa, synthetic construct
  REGION 1..925: note = Ce_VH-CH1/N84S/knob/CD40L
QVQLKQSGPGLVQPSQSLSITCTVSGFSLTNYGVHWVRQSPGKGLEWLGVIWSGGNTDYNTPFTSRLSINKDNSKSQVFFKMSSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGSGGGGSEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKLGGGSGGGGSEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKLGGGSGGGGSEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 5083 - protein, 927 aa, synthetic construct
  REGION 1..927: note = Cg_VH-CH1/N84S/knob/CD40L
QVQLVQSGAEVKKPGASVKVSCKASGYTFTEFGMNWVRQAPGQGLEWMGWINTKTGEATYVEEFKGRVTFTTDTSTSTAYMELRSLRSDDTAVYYCARWDFAYYVEAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGSGGGGSEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKLGGGSGGGGSEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKLGGGSGGGGSEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 5084 - protein, 213 aa, synthetic construct; identical to SEQ ID NO: 1
  REGION 1..213: note = R_VK-CK

SEQ ID NO: 5085 - protein, 214 aa, synthetic construct; identical to SEQ ID NO: 686
  REGION 1..214: note = Da_VK-CK

SEQ ID NO: 5086 - protein, 214 aa, synthetic construct; identical to SEQ ID NO: 247
  REGION 1..214: note = Tr_VK-CK

SEQ ID NO: 5087 - protein, 214 aa, synthetic construct
  REGION 1..214: note = Ce_VK-CK
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5088 - protein, 215 aa, synthetic construct; identical to SEQ ID NO: 51
  REGION 1..215: note = Cg_VK-CK

SEQ ID NO: 5089 - protein, 221 aa, synthetic construct; identical to SEQ ID NO: 4828
  REGION 1..221: note = Fc6/knob

SEQ ID NO: 5090 - protein, 698 aa, synthetic construct
  REGION 1..698: note = Fc6/knob/CD40L
CPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGSGGGGSEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKLGGGSGGGGSEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKLGGGSGGGGSEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 5091 - protein, 449 aa, synthetic construct
  REGION 1..449: note = Tr_VH-CH
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 5092 - protein, 448 aa, synthetic construct
  REGION 1..448: note = Ce_VH-CH
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 5093 - protein, 448 aa, synthetic construct
  REGION 1..448: note = Pt_VH-CH
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 5094 - protein, 450 aa, synthetic construct
  REGION 1..450: note = Cg_VH-CH/PGLALA
QVQLVQSGAEVKKPGASVKVSCKASGYTFTEFGMNWVRQAPGQGLEWMGWINTKTGEATYVEEFKGRVTFTTDTSTSTAYMELRSLRSDDTAVYYCARWDFAYYVEAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 5095 - protein, 452 aa, synthetic construct
  REGION 1..452: note = Be_VH-CH
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 5096 - protein, 445 aa, synthetic construct
  REGION 1..445: note = Ra_VH-CH
EVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARVTDAFDIWGQGTMVTVSSASTKGPSVLPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 5097 - protein, 344 aa, synthetic construct
  REGION 1..344: note = SIRPA_Fc
EEELQVIQPDKSVSVAAGESAILHCTVTSLIPVGPIQWFRGAGPARELIYNQKEGHFPRVTTVSESTKRENMDFSISISNITPADAGTYYCVKFRKGSPDTEFKSGAGTELSVRAKPSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 5098 - protein, 376 aa, synthetic construct
  REGION 1..376: note = IL-22_Fc
APISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACIRVESKYGPPCPPCPAPEFLGGPSVFLFPPKPKDTLMISRTPEVTCVVVDVSQEDPEVQFNWYVDGVEVHNAKTKPREEQFGSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 5099 - protein, 214 aa, synthetic construct; identical to SEQ ID NO: 247
  REGION 1..214: note = Tr_VK-CK

SEQ ID NO: 5100 - protein, 214 aa, synthetic construct; identical to SEQ ID NO: 5087
  REGION 1..214: note = Ce_VK-CK

SEQ ID NO: 5101 - protein, 214 aa, synthetic construct
  REGION 1..214: note = Pt_VK-CK
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5102 - protein, 215 aa, synthetic construct; identical to SEQ ID NO: 51
  REGION 1..215: note = Cg_VK-CK

SEQ ID NO: 5103 - protein, 214 aa, synthetic construct
  REGION 1..214: note = Be_VK-CK
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5104 - protein, 214 aa, synthetic construct
  REGION 1..214: note = Ra_VK-CK
DIQMTQSPSSVSASIGDRVTITCRASQGIDNWLGWYQQKPGKAPKLLIYDASNLDTGVPSRFSGSGSGTYFTLTISSLQAEDFAVYFCQQAKAFPPTFGGGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5105 - protein, 119 aa, synthetic construct
  REGION 1..119: note = abagovomab heavy chain V region
QVKLQESGAELARPGASVKLSCKASGYTFTNYWMQWVKQRPGQGLDWIGAIYPGDGNTRYTHKFKGKATLTADKSSSTAYMQLSSLASEDSGVYYCARGEGNYAWFAYWGQGTTVTVSS

SEQ ID NO: 5106 - protein, 9 aa, synthetic construct
  REGION 1..9: note = abagovomab heavy chain CDR1
GYTFTNYWM

SEQ ID NO: 5107 - protein, 8 aa, synthetic construct
  REGION 1..8: note = abagovomab heavy chain CDR2
IYPGDGNT

SEQ ID NO: 5108 - protein, 12 aa, synthetic construct
  REGION 1..12: note = abagovomab heavy chain CDR3
ARGEGNYAWFAY

SEQ ID NO: 5109 - protein, 107 aa, synthetic construct
  REGION 1..107: note = abagovomab light chain V region
DIELTQSPASLSASVGETVTITCQASENIYSYLAWHQQKQGKSPQLLVYNAKTLAGGVSSRFSGSGSGTHFSLKIKSLQPEDFGIYYCQHHYGILPTFGGGTKLEIK

SEQ ID NO: 5110 - protein, 6 aa, synthetic construct
  REGION 1..6: note = abagovomab light chain CDR1
ENIYSY

SEQ ID NO: 5111 - skipped

SEQ ID NO: 5112 - protein, 9 aa, synthetic construct
  REGION 1..9: note = abagovomab light chain CDR3
QHHYGILPT

SEQ ID NO: 5113 - protein, 122 aa, synthetic construct
  REGION 1..122: note = abelacimab heavy chain V region
QVQLLESGGGLVQPGGSLRLSCAASGFTFSTAAMSWVRQAPGKGLEWVSGISGSGSSTYYADSVKGRFTISRDNSKNTLYLQMNSLRAEDTAVYYCARELSYLYSGYYFDYWGQGTLVTVSS

SEQ ID NO: 5114 - protein, 8 aa, synthetic construct
  REGION 1..8: note = abelacimab heavy chain CDR1
GFTFSTAA

SEQ ID NO: 5115 - protein, 8 aa, synthetic construct
  REGION 1..8: note = abelacimab heavy chain CDR2
ISGSGSST

SEQ ID NO: 5116 - protein, 15 aa, synthetic construct
  REGION 1..15: note = abelacimab heavy chain CDR3
ARELSYLYSGYYFDY

SEQ ID NO: 5117 - protein, 121 aa, synthetic construct
  REGION 1..121: note = abelacimab light chain V region
QSVLTQPPSASGTPGQRVTISCSGSSSNIGSNDVSWYQQLPGTAPKLLIYKNYNRPSGVPDRFSGSKSGTSASLAISGLQSEDEADYYCSAWDQRQFDVVFGGGTKLTVLGQPKAAPSVTL

SEQ ID NO: 5118 - protein, 8 aa, synthetic construct
  REGION 1..8: note = abelacimab light chain CDR1
SSNIGSND

SEQ ID NO: 5119 - skipped

SEQ ID NO: 5120 - protein, 11 aa, synthetic construct
  REGION 1..11: note = abelacimab light chain CDR3
SAWDQRQFDVV

SEQ ID NO: 5121 - protein, 118 aa, synthetic construct [sequence omitted]

SEQ ID NO: 5122 - protein, 8 aa, synthetic construct
  REGION 1..8: note = abituzumab heavy chain CDR1
GYTFSSFW

SEQ ID NO: 5123 - protein, 8 aa, synthetic construct
  REGION 1..8: note = abituzumab heavy chain CDR2
INPRSGYT

SEQ ID NO: 5124 - protein, 11 aa, synthetic construct
  REGION 1..11: note = abituzumab heavy chain CDR3
ASFLGRGAMDY

SEQ ID NO: 5125 - protein, 107 aa, synthetic construct [sequence omitted]

SEQ ID NO: 5126 - protein, 6 aa, synthetic construct
  REGION 1..6: note = abituzumab light chain CDR1
QDISNY

SEQ ID NO: 5127 - skipped

SEQ ID NO: 5128 - protein, 9 aa, synthetic construct
  REGION 1..9: note = abituzumab light chain CDR3
QQGNTFPYT

SEQ ID NO: 5129 - protein, 120 aa, synthetic construct
  REGION 1..120: note = abrezekimab heavy chain V region
QVTLKESGPVLVKPTETLTLTCTVSGFSLTNYHVQWIRQPPGKALEWLGVMWSDGDTSFNSVLKSRLTISRDTSKSQVVLTMTNMDPVDTATYYCARDGTIAAMDYFDYWGQGTLVTVSS

SEQ ID NO: 5130 - protein, 8 aa, synthetic construct
  REGION 1..8: note = abrezekimab heavy chain CDR1
GFSLTNYH

SEQ ID NO: 5131 - protein, 7 aa, synthetic construct
  REGION 1..7: note = abrezekimab heavy chain CDR2
MWSDGDT

SEQ ID NO: 5132 - protein, 14 aa, synthetic construct
  REGION 1..14: note = abrezekimab heavy chain CDR3
ARDGTIAAMDYFDY

SEQ ID NO: 5133 - protein, 107 aa, synthetic construct
  REGION 1..107: note = abrezekimab light chain V region
DIQMTQSPSSLSASVGDRVTITCLASEDISNYLAWYQQKPGKAPKLLIYHTSRLQDGVPSRFSGSGSGTDFTLTISSLQPEDFATYYCQQGYRFPLTFGGGTKVEIK

SEQ ID NO: 5134 - protein, 6 aa, synthetic construct
  REGION 1..6: note = abrezekimab light chain CDR1
EDISNY

SEQ ID NO: 5135 - skipped

SEQ ID NO: 5136 - protein, 9 aa, synthetic construct
  REGION 1..9: note = abrezekimab light chain CDR3
QQGYRFPLT

SEQ ID NO: 5137 - protein, 118 aa, synthetic construct [sequence omitted]

SEQ ID NO: 5138 - protein, 8 aa, synthetic construct
  REGION 1..8: note = abrilumab heavy chain CDR1
GYTLSDLS

SEQ ID NO: 5139 - protein, 8 aa, synthetic construct
  REGION 1..8: note = abrilumab heavy chain CDR2
FDPQDGET

SEQ ID NO: 5140 - protein, 11 aa, synthetic construct
  REGION 1..11: note = abrilumab heavy chain CDR3
ATGSSSSWFDP

SEQ ID NO: 5141 - protein, 107 aa, synthetic construct [sequence omitted]

SEQ ID NO: 5142 - protein, 6 aa, synthetic construct
  REGION 1..6: note = abrilumab light chain CDR1
QGISSW

SEQ ID NO: 5143 - skipped

SEQ ID NO: 5144 - protein, 9 aa, synthetic construct
  REGION 1..9: note = abrilumab light chain CDR3
QQANSFPWT

SEQ ID NO: 5145 - protein, 121 aa, synthetic construct
  REGION 1..121: note = acapatamab heavy chain V region
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSS

SEQ ID NO: 5146 - protein, 8 aa, synthetic construct
  REGION 1..8: note = acapatamab heavy chain CDR1
GFTFSDYY

SEQ ID NO: 5147 - protein, 8 aa, synthetic construct
  REGION 1..8: note = acapatamab heavy chain CDR2
ISDGGYYT

SEQ ID NO: 5148 - protein, 14 aa, synthetic construct
  REGION 1..14: note = acapatamab heavy chain CDR3
ARGFPLLRHGAMDY

SEQ ID NO: 5149 - protein, 107 aa, synthetic construct
  REGION 1..107: note = acapatamab light chain V region
DIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGCGTKLEIK

SEQ ID NO: 5150 - protein, 6 aa, synthetic construct
  REGION 1..6: note = acapatamab light chain CDR1
QNVDTN

SEQ ID NO: 5151 - skipped

SEQ ID NO: 5152 - protein, 9 aa, synthetic construct
  REGION 1..9: note = acapatamab light chain CDR3
QQYDQQLIT

SEQ ID NO: 5153 - protein, 121 aa, synthetic construct
  REGION 1..121: note = acasunlimab heavy chain V region
EVQLLEPGGGLVQPGGSLRLSCEASGSTFSTYAMSWVRQAPGKGLEWVSGFSGSGGFTFYADSVRGRFTISRDSSKNTLFLQMSSLRAEDTAVYYCAIPARGYNYGSFQHWGQGTLVTVSS

SEQ ID NO: 5154 - protein, 8 aa, synthetic construct
  REGION 1..8: note = acasunlimab heavy chain CDR1
GSTFSTYA

SEQ ID NO: 5155 - protein, 8 aa, synthetic construct
  REGION 1..8: note = acasunlimab heavy chain CDR2
FSGSGGFT

SEQ ID NO: 5156 - protein, 14 aa, synthetic construct
  REGION 1..14: note = acasunlimab heavy chain CDR3
AIPARGYNYGSFQH

SEQ ID NO: 5157 - protein, 108 aa, synthetic construct
  REGION 1..108: note = acasunlimab light chain V region
SYVLTQPPSVSVAPGQTARITCGGNNIGSKSVHWYQQKPGQAPVLVVYDDNDRPSGLPERFSGSNSGNTATLTISRVEAGDEADYYCQVWDSSSDHVVFGGGTKLTVL

SEQ ID NO: 5158 - protein, 6 aa, synthetic construct
  REGION 1..6: note = acasunlimab light chain CDR1
NIGSKS

SEQ ID NO: 5159 - skipped

SEQ ID NO: 5160 - protein, 11 aa, synthetic construct
  REGION 1..11: note = acasunlimab light chain CDR3
QVWDSSSDHVV

SEQ ID NO: 5161 - protein, 122 aa, synthetic construct
  REGION 1..122: note = actoxumab heavy chain V region
QVQLVESGGGVVQPGRSLRLSCAASGFSFSNYGMHWVRQAPGKGLEWVALIWYDGSNEDYTDSVKGRFTISRDNSKNTLYLQMNSLRAEDTAVYYCARWGMVRGVIDVFDIWGQGTVVTVSS

SEQ ID NO: 5162 - protein, 8 aa, synthetic construct
  REGION 1..8: note = actoxumab heavy chain CDR1
GFSFSNYG

SEQ ID NO: 5163 - protein, 8 aa, synthetic construct
  REGION 1..8: note = actoxumab heavy chain CDR2
IWYDGSNE

SEQ ID NO: 5164 - protein, 15 aa, synthetic construct
  REGION 1..15: note = actoxumab heavy chain CDR3
ARWGMVRGVIDVFDI

SEQ ID NO: 5165 - protein, 107 aa, synthetic construct
  REGION 1..107: note = actoxumab light chain V region
DIQMTQSPSSVSASVGDRVTITCRASQGISSWLAWYQHKPGKAPKLLIYAASSLQSGVPSRFSGSGSGTDFTLTISSLQPEDFATYYCQQANSFPWTFGQGTKVEIK

SEQ ID NO: 5166 - protein, 6 aa, synthetic construct
  REGION 1..6: note = actoxumab light chain CDR1
QGISSW

SEQ ID NO: 5167 - skipped

SEQ ID NO: 5168 - protein, 9 aa, synthetic construct
  REGION 1..9: note = actoxumab light chain CDR3
QQANSFPWT

SEQ ID NO: 5169 - protein, 107 aa, synthetic construct
  REGION 1..107: note = adalimumab beta heavy chain V region
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASS

SEQ ID NO: 5170 - protein, 8 aa, synthetic construct
  REGION 1..8: note = adalimumab beta heavy chain CDR1
GFTFDDYA

SEQ ID NO: 5171 - protein, 8 aa, synthetic construct
  REGION 1..8: note = adalimumab beta heavy chain CDR2
ITWNSGHI

SEQ ID NO: 5172 - protein, 14 aa, synthetic construct
  REGION 1..14: note = adalimumab beta heavy chain CDR3
AKVSYLSTASSLDY

SEQ ID NO: 5173 - protein, 107 aa, synthetic construct [sequence omitted]

SEQ ID NO: 5174 - protein, 6 aa, synthetic construct
  REGION 1..6: note = adalimumab beta light chain CDR1
QGIRNY

SEQ ID NO: 5175 - skipped

SEQ ID NO: 5176 - protein, 9 aa, synthetic construct
  REGION 1..9: note = adalimumab beta light chain CDR3
QRYNRAPYT

SEQ ID NO: 5177 - protein, 119 aa, synthetic construct
  REGION 1..119: note = adebrelimab heavy chain V region
QVQLVQSGAEVKKPGASVKVSCKASGYTFTSYWMHWVRQAPGQGLEWMGRIGPNSGFTSYNEKFKNRVTMTRDTSTSTVYMELSSLRSEDTAVYYCARGGSSYDYFDYWGQGTTVTVSS

SEQ ID NO: 5178 - protein, 8 aa, synthetic construct
  REGION 1..8: note = adebrelimab heavy chain CDR1
GYTFTSYW

SEQ ID NO: 5179 - protein, 8 aa, synthetic construct
  REGION 1..8: note = adebrelimab heavy chain CDR2
IGPNSGFT

SEQ ID NO: 5180 - protein, 12 aa, synthetic construct
  REGION 1..12: note = adebrelimab heavy chain CDR3
ARGGSSYDYFDY

SEQ ID NO: 5181 - protein, 111 aa, synthetic construct
  REGION 1..111: note = adebrelimab light chain V region
DIVLTQSPASLAVSPGQRATITCRASESVSIHGTHLMHWYQQKPGQPPKLLIYAASNLESGVPARFSGSGSGTDFTLTINPVEAEDTANYYCQQSFEDPLTFGQGTKLEIK

SEQ ID NO: 5182 - protein, 10 aa, synthetic construct
  REGION 1..10: note = adebrelimab light chain CDR1
ESVSIHGTHL

SEQ ID NO: 5183 - skipped

SEQ ID NO: 5184 - protein, 9 aa, synthetic construct
  REGION 1..9: note = adebrelimab light chain CDR3
QQSFEDPLT

SEQ ID NO: 5185 - protein, 124 aa, synthetic construct
  REGION 1..124: note = adintrevimab heavy chain V region
EVQLVESGGGLVKPGGSLRLSCAASGFTFSSYYMNWVRQAPGKGLEWVSSISEDGYSTYYPDSLKGRFTISRDSAKNSLYLQMNSLRADDTAVYYCARDFSGHTAWAGTGFEYWGQGTLVTVSS

SEQ ID NO: 5186 - protein, 8 aa, synthetic construct
  REGION 1..8: note = adintrevimab heavy chain CDR1
GFTFSSYY

SEQ ID NO: 5187 - protein, 8 aa, synthetic construct
  REGION 1..8: note = adintrevimab heavy chain CDR2
ISEDGYST

SEQ ID NO: 5188 - protein, 17 aa, synthetic construct
  REGION 1..17: note = adintrevimab heavy chain CDR3
ARDFSGHTAWAGTGFEY

SEQ ID NO: 5189 - protein, 112 aa, synthetic construct
  REGION 1..112: note = adintrevimab light chain V region
QSVLTQPPSVSGAPGQRITISCTGSSSNIGAGYDVHWYQQLPGTAPKLLIYGSSSRNSGVPDRFSGSKSGTSASLAITGLQAEDEADYYCQSYDSSLSVLYTFGTGTKVTVL

SEQ ID NO: 5190 - protein, 9 aa, synthetic construct
  REGION 1..9: note = adintrevimab light chain CDR1
SSNIGAGYD

SEQ ID NO: 5191 - skipped

SEQ ID NO: 5192 - protein, 12 aa, synthetic construct
  REGION 1..12: note = adintrevimab light chain CDR3
QSYDSSLSVLYT

SEQ ID NO: 5193 - protein, 124 aa, synthetic construct
  REGION 1..124: note = aducanumab heavy chain V region
QVQLVESGGGVVQPGRSLRLSCAASGFAFSSYGMHWVRQAPGKGLEWVAVIWFDGTKKYYTDSVKGRFTISRDNSKNTLYLQMNTLRAEDTAVYYCARDRGIGARRGPYYMDVWGKGTTVTVSS

SEQ ID NO: 5194 - protein, 8 aa, synthetic construct
  REGION 1..8: note = aducanumab heavy chain CDR1
GFAFSSYG

SEQ ID NO: 5195 - protein, 8 aa, synthetic construct
  REGION 1..8: note = aducanumab heavy chain CDR2
IWFDGTKK

SEQ ID NO: 5196 - protein, 10 aa, synthetic construct
  REGION 1..10: note = aducanumab heavy chain CDR3
ARRGPYYMDV

SEQ ID NO: 5197 - protein, 107 aa, synthetic construct [sequence omitted]

SEQ ID NO: 5198 - protein, 6 aa, synthetic construct
  REGION 1..6: note = aducanumab light chain CDR1
QSISSY

SEQ ID NO: 5199 - skipped

SEQ ID NO: 5200 - protein, 9 aa, synthetic construct
  REGION 1..9: note = aducanumab light chain CDR3
QQSYSTPLT

SEQ ID NO: 5201 - protein, 123 aa, synthetic construct
  REGION 1..123: note = afasevikumab heavy chain V region
EVQLVESGGGLVQPGRSLRLSCAASGFTFDDYAMHWVRQAPGKGLEWVSGINWSSGGIGYADSVKGRFTISRDNAKNSLYLQMNSLRAEDTALYYCARDIGGFGEFYWNFGLWGRGTLVTVSS

SEQ ID NO: 5202 - protein, 8 aa, synthetic construct
  REGION 1..8: note = afasevikumab heavy chain CDR1
GFTFDDYA

SEQ ID NO: 5203 - protein, 8 aa, synthetic construct
  REGION 1..8: note = afasevikumab heavy chain CDR2
INWSSGGI

SEQ ID NO: 5204 - protein, 16 aa, synthetic construct
  REGION 1..16: note = afasevikumab heavy chain CDR3
ARDIGGFGEFYWNFGL

SEQ ID NO: 5205 - protein, 108 aa, synthetic construct
  REGION 1..108: note = afasevikumab light chain V region
EIVLTQSPATLSLSPGERATLSCRASQSVRSYLAWYQQKPGQAPRLLIYDASNRATGIPARFSGSGSGTDFTLTISSLEPEDFAVYYCQQRSNWPPATFGGGTKVEIK

SEQ ID NO: 5206 - protein, 6 aa, synthetic construct
  REGION 1..6: note = afasevikumab light chain CDR1
QSVRSY

SEQ ID NO: 5207 - skipped

SEQ ID NO: 5208 - protein, 10 aa, synthetic construct
  REGION 1..10: note = afasevikumab light chain CDR3
QQRSNWPPAT

SEQ ID NO: 5209 - protein, 121 aa, synthetic construct
  REGION 1..121: note = alemtuzumab heavy chain V region
QVQLQESGPGLVRPSQTLSLTCTVSGFTFTDFYMNWVRQPPGRGLEWIGFIRDKAKGYTTEYNPSVKGRVTMLVDTSKNQFSLRLSSVTAADTAVYYCAREGHTAAPFDYWGQGSLVTVSS

SEQ ID NO: 5210 - protein, 8 aa, synthetic construct
  REGION 1..8: note = alemtuzumab heavy chain CDR1
GFTFTDFY

SEQ ID NO: 5211 - protein, 10 aa, synthetic construct
  REGION 1..10: note = alemtuzumab heavy chain CDR2
IRDKAKGYTT

SEQ ID NO: 5212 - protein, 12 aa, synthetic construct
  REGION 1..12: note = alemtuzumab heavy chain CDR3
AREGHTAAPFDY

SEQ ID NO: 5213 - protein, 107 aa, synthetic construct
  REGION 1..107: note = alemtuzumab light chain V region
DIQMTQSPSSLSASVGDRVTITCKASQNIDKYLNWYQQKPGKAPKLLIYNTNNLQTGVPSRFSGSGSGTDFTFTISSLQPEDIATYYCLQHISRPRTFGQGTKVEIK

SEQ ID NO: 5214 - protein, 6 aa, synthetic construct
  REGION 1..6: note = alemtuzumab light chain CDR1
QNIDKY

SEQ ID NO: 5215 - skipped

SEQ ID NO: 5216 - protein, 9 aa, synthetic construct
  REGION 1..9: note = alemtuzumab light chain CDR3
LQHISRPRT

SEQ ID NO: 5217 - protein, 118 aa, synthetic construct [sequence omitted]

SEQ ID NO: 5218 - protein, 8 aa, synthetic construct
  REGION 1..8: note = alirocumab heavy chain CDR1
GFTFNNYA

SEQ ID NO: 5219 - protein, 8 aa, synthetic construct
  REGION 1..8: note = alirocumab heavy chain CDR2
ISGSGGTT

SEQ ID NO: 5220 - protein, 11 aa, synthetic construct
  REGION 1..11: note = alirocumab heavy chain CDR3
AKDSNWGNFDL

SEQ ID NO: 5221 - protein, 113 aa, synthetic construct [sequence omitted]

SEQ ID NO: 5222 - protein, 12 aa, synthetic construct
  REGION 1..12: note = alirocumab light chain CDR1
QSVLYRSNNRNF

SEQ ID NO: 5223 - skipped

SEQ ID NO: 5224 - protein, 9 aa, synthetic construct
  REGION 1..9: note = alirocumab light chain CDR3
QQYYTTPYT

SEQ ID NO: 5225 - protein, 124 aa, synthetic construct
  REGION 1..124: note = alomfilimab heavy chain V region
EVQLVESGGGVVRPGGSLRLSCVASGVTFDDYGMSWVRQAPGKGLEWVSGINWNGGDTDYSDSVKGRFTISRDNAKNSLYLQMNSLRAEDTALYYCARDFYGSGSYYHVPFDYWGQGILVTVSS

SEQ ID NO: 5226 - protein, 8 aa, synthetic construct
  REGION 1..8: note = alomfilimab heavy chain CDR1
GVTFDDYG

SEQ ID NO: 5227 - protein, 8 aa, synthetic construct
  REGION 1..8: note = alomfilimab heavy chain CDR2
INWNGGDT

SEQ ID NO: 5228 - protein, 17 aa, synthetic construct
  REGION 1..17: note = alomfilimab heavy chain CDR3
ARDFYGSGSYYHVPFDY

SEQ ID NO: 5229 - protein, 108 aa, synthetic construct
  REGION 1..108: note = alomfilimab light chain V region
EIVLTQSPGTLSLSPGERATLSCRASQSVSRSYLAWYQQKRGQAPRLLIYGASSRATGIPDRFSGDGSGTDFTLSISRLEPEDFAVYYCHQYDMSPFTFGPGTKVDIK

SEQ ID NO: 5230 - protein, 7 aa, synthetic construct
  REGION 1..7: note = alomfilimab light chain CDR1
QSVSRSY

SEQ ID NO: 5231 - skipped

SEQ ID NO: 5232 - protein, 9 aa, synthetic construct
  REGION 1..9: note = alomfilimab light chain CDR3
HQYDMSPFT

SEQ ID NO: 5233 - protein, 120 aa, synthetic construct
  REGION 1..120: note = alsevalimab heavy chain V region
QLQLQESGPGLVKPSETLSLTCTVSGGSIKSGSYYWGWIRQPPGKGLEWIGNIYYSGSTYYNPSLRSRVTISVDTSKNQFSLKLSSVTAADTAVYYCAREGSYPNQFDPWGQGTLVTVSS

SEQ ID NO: 5234 - protein, 10 aa, synthetic construct
  REGION 1..10: note = alsevalimab heavy chain CDR1
GGSIKSGSYY

SEQ ID NO: 5235 - protein, 7 aa, synthetic construct
  REGION 1..7: note = alsevalimab heavy chain CDR2
IYYSGST

SEQ ID NO: 5236 - protein, 12 aa, synthetic construct
  REGION 1..12: note = alsevalimab heavy chain CDR3
AREGSYPNQFDP

SEQ ID NO: 5237 - protein, 107 aa, synthetic construct
  REGION 1..107: note = alsevalimab light chain V region
EIVMTQSPATLSVSPGERATLSCRASQSVSSNLAWYQQKPGQAPRLLIYGASTRATGIPARFSGSGSGTEFTLTISSLQSEDFAVYYCQQYHSFPFTFGGGTKVEIK

SEQ ID NO: 5238 - protein, 6 aa, synthetic construct
  REGION 1..6: note = alsevalimab light chain CDR1
QSVSSN

SEQ ID NO: 5239 - skipped

SEQ ID NO: 5240 - protein, 9 aa, synthetic construct
  REGION 1..9: note = alsevalimab light chain CDR3
QQYHSFPFT

SEQ ID NO: 5241 - protein, 125 aa, synthetic construct [sequence omitted]

SEQ ID NO: 5242 - protein, 8 aa, synthetic construct
  REGION 1..8: note = amivantamab heavy chain CDR1
GFTFSTYG

SEQ ID NO: 5243 - protein, 8 aa, synthetic construct
  REGION 1..8: note = amivantamab heavy chain CDR2
IWDDGSYK

SEQ ID NO: 5244 - protein, 18 aa, synthetic construct
  REGION 1..18: note = amivantamab heavy chain CDR3
ARDGITMVRGVMKDYFDY

SEQ ID NO: 5245 - protein, 107 aa, synthetic construct [sequence omitted]

SEQ ID NO: 5246 - protein, 6 aa, synthetic construct
  REGION 1..6: note = amivantamab light chain CDR1
QDISSA

SEQ ID NO: 5247 - skipped

SEQ ID NO: 5248 - protein, 9 aa, synthetic construct
  REGION 1..9: note = amivantamab light chain CDR3
QQFNSYPLT

SEQ ID NO: 5249 - protein, 117 aa, synthetic construct
  REGION 1..117: note = amubarvimab heavy chain V region
EVQLVESGGGLVQPGGSLRLSCAASGITVSSNYMNWVRQAPGKGLEWVSLIYSGGSTYYADSVKGRFTISRDNSKNTLYLQMNSLRAEDTAVYHCARDLVVYGMDVWGQGTTVTVSS

SEQ ID NO: 5250 - protein, 8 aa, synthetic construct
  REGION 1..8: note = amubarvimab heavy chain CDR1
GITVSSNY

SEQ ID NO: 5251 - protein, 7 aa, synthetic construct
  REGION 1..7: note = amubarvimab heavy chain CDR2
IYSGGST

SEQ ID NO: 5252 - protein, 11 aa, synthetic construct
  REGION 1..11: note = amubarvimab heavy chain CDR3
ARDLVVYGMDV

SEQ ID NO: 5253 - protein, 107 aa, synthetic construct
  REGION 1..107: note = amubarvimab light chain V region
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTKLEIK

SEQ ID NO: 5254 - protein, 7 aa, synthetic construct
  REGION 1..7: note = amubarvimab light chain CDR1
QSVSSSY

SEQ ID NO: 5255 - skipped

SEQ ID NO: 5256 - protein, 8 aa, synthetic construct
  REGION 1..8: note = amubarvimab light chain CDR3
QQYGSSPT

SEQ ID NO: 5257 - protein, 120 aa, synthetic construct
  REGION 1..120: note = anetumab corixetan heavy chain V region
QVELVQSGAEVKKPGESLKISCKGSGYSFTSYWIGWVRQAPGKGLEWMGIIDPGDSRTRYSPSFQGQVTISADKSISTAYLQWSSLKASDTAMYYCARGQLYGGTYMDGWGQGTLVTVSS

SEQ ID NO: 5258 - protein, 8 aa, synthetic construct
  REGION 1..8: note = anetumab corixetan heavy chain CDR1
GYSFTSYW

SEQ ID NO: 5259 - protein, 8 aa, synthetic construct
  REGION 1..8: note = anetumab corixetan heavy chain CDR2
IDPGDSRT

SEQ ID NO: 5260 - protein, 13 aa, synthetic construct
  REGION 1..13: note = anetumab corixetan heavy chain CDR3
ARGQLYGGTYMDG

SEQ ID NO: 5261 - protein, 111 aa, synthetic construct
  REGION 1..111: note = anetumab corixetan light chain V region
DIALTQPASVSGSPGQSITISCTGTSSDIGGYNSVSWYQQHPGKAPKLMIYGVNNRPSGVSNRFSGSKSGNTASLTISGLQAEDEADYYCSSYDIESATPVFGGGTKLTVL

SEQ ID NO: 5262 - protein, 9 aa, synthetic construct
  REGION 1..9: note = anetumab corixetan light chain CDR1
SSDIGGYNS

SEQ ID NO: 5263 - skipped

SEQ ID NO: 5264 - protein, 11 aa, synthetic construct
  REGION 1..11: note = anetumab corixetan light chain CDR3
SSYDIESATPV

SEQ ID NO: 5265 - protein, 120 aa, synthetic construct; identical to SEQ ID NO: 5257
  REGION 1..120: note = anetumab ravtansine heavy chain V region

SEQ ID NO: 5266 - protein, 8 aa, synthetic construct
  REGION 1..8: note = anetumab ravtansine heavy chain CDR1
GYSFTSYW

SEQ ID NO: 5267 - protein, 8 aa, synthetic construct
  REGION 1..8: note = anetumab ravtansine heavy chain CDR2
IDPGDSRT

SEQ ID NO: 5268 - protein, 13 aa, synthetic construct
  REGION 1..13: note = anetumab ravtansine heavy chain CDR3
ARGQLYGGTYMDG

SEQ ID NO: 5269 - protein, 111 aa, synthetic construct; identical to SEQ ID NO: 5261
  REGION 1..111: note = anetumab ravtansine light chain V region

SEQ ID NO: 5270 - protein, 9 aa, synthetic construct
  REGION 1..9: note = anetumab ravtansine light chain CDR1
SSDIGGYNS

SEQ ID NO: 5271 - skipped

SEQ ID NO: 5272 - protein, 11 aa, synthetic construct
  REGION 1..11: note = anetumab ravtansine light chain CDR3
SSYDIESATPV

SEQ ID NO: 5273 - protein, 117 aa, synthetic construct [sequence omitted]

SEQ ID NO: 5274 - protein, 8 aa, synthetic construct
  REGION 1..8: note = anifrolumab heavy chain CDR1
GYIFTNYW

SEQ ID NO: 5275 - protein, 8 aa, synthetic construct
  REGION 1..8: note = anifrolumab heavy chain CDR2
IYPGDSDI

SEQ ID NO: 5276 - protein, 10 aa, synthetic construct
  REGION 1..10: note = anifrolumab heavy chain CDR3
ARHDIEGFDY

SEQ ID NO: 5277 - protein, 108 aa, synthetic construct [sequence omitted]

SEQ ID NO: 5278 - protein, 8 aa, synthetic construct
  REGION 1..8: note = anifrolumab light chain CDR1
QSVSSSFF

SEQ ID NO: 5279 - skipped

SEQ ID NO: 5280 - protein, 9 aa, synthetic construct
  REGION 1..9: note = anifrolumab light chain CDR3
QQYDSSAIT

SEQ ID NO: 5281 - protein, 119 aa, synthetic construct
  REGION 1..119: note = ansuvimab heavy chain V region
EVQLVESGGGLIQPGGSLRLSCAASGFALRMYDMHWVRQTIDKRLEWVSAVGPSGDTTYADSVKGRFAVSRENAKNSLSLQMNSLTAGDTAIYYCVRSDRGVAGLFDSWGQGILVTVSS

SEQ ID NO: 5282 - protein, 8 aa, synthetic construct
  REGION 1..8: note = ansuvimab heavy chain CDR1
GFALRMYD

SEQ ID NO: 5283 - protein, 7 aa, synthetic construct
  REGION 1..7: note = ansuvimab heavy chain CDR2
VGPSGDT

SEQ ID NO: 5284 - protein, 13 aa, synthetic construct
  REGION 1..13: note = ansuvimab heavy chain CDR3
VRSDRGVAGLFDS

SEQ ID NO: 5285 - protein, 107 aa, synthetic construct [sequence omitted]

SEQ ID NO: 5286 - protein, 6 aa, synthetic construct
  REGION 1..6: note = ansuvimab light chain CDR1
QAFDNY

SEQ ID NO: 5287 - skipped

SEQ ID NO: 5288 - protein, 9 aa, synthetic construct
  REGION 1..9: note = ansuvimab light chain CDR3
QNYNSAPLT

SEQ ID NO: 5289 - protein, 118 aa, synthetic construct
  REGION 1..118: note = anumigilimab heavy chain V region
EVQLLESGGGLVQPGGSLRLSCAASGFTFSLYWMGWVRQAPGKGLEWVSSISSSGGVTPYADSVKGRFTISRDNSKNTLYLQMNSLRAEDTAVYYCAKLGELGWFDPWGQGTLVTVSS

SEQ ID NO: 5290 - protein, 8 aa, synthetic construct
  REGION 1..8: note = anumigilimab heavy chain CDR1
GFTFSLYW

SEQ ID NO: 5291 - protein, 8 aa, synthetic construct
  REGION 1..8: note = anumigilimab heavy chain CDR2
ISSSGGVT

SEQ ID NO: 5292 - protein, 11 aa, synthetic construct
  REGION 1..11: note = anumigilimab heavy chain CDR3
AKLGELGWFDP

SEQ ID NO: 5293 - protein, 107 aa, synthetic construct
  REGION 1..107: note = anumigilimab light chain V region
DIQMTQSPSSLSASVGDRVTITCRASQGISSYLNWYQQKPGKAPKLLIYYASNLQNGVPSRFSGSGSGTDFTLTISSLQPEDFATYYCQQSYSTPLTFGGGTKVEIK

SEQ ID NO: 5294 - protein, 6 aa, synthetic construct
  REGION 1..6: note = anumigilimab light chain CDR1
QGISSY

SEQ ID NO: 5295 - skipped

SEQ ID NO: 5296 - protein, 9 aa, synthetic construct
  REGION 1..9: note = anumigilimab light chain CDR3
QQSYSTPLT

SEQ ID NO: 5297 - protein, 126 aa, synthetic construct
  REGION 1..126: note = apitegromab heavy chain V region
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDLLVRFLEWSHYYGMDVWGQGTTVTVSS

SEQ ID NO: 5298 - protein, 8 aa, synthetic construct
  REGION 1..8: note = apitegromab heavy chain CDR1
GFTFSSYG

SEQ ID NO: 5299 - protein, 8 aa, synthetic construct
  REGION 1..8: note = apitegromab heavy chain CDR2
ISYDGSNK

SEQ ID NO: 5300 - protein, 19 aa, synthetic construct
  REGION 1..19: note = apitegromab heavy chain CDR3
ARDLLVRFLEWSHYYGMDV

SEQ ID NO: 5301 - protein, 109 aa, synthetic construct
  REGION 1..109: note = apitegromab light chain V region
QSVLTQPPSASGTPGQRVTISCSGSSSNIGSNTVHWYQQLPGTAPKLLIYSDNQRPSGVPDRFSGSKSGTSASLAISGLQSEDEADYYCAAWDDSLNGVFGGGTKLTVL

SEQ ID NO: 5302 - protein, 8 aa, synthetic construct
  REGION 1..8: note = apitegromab light chain CDR1
SSNIGSNT

SEQ ID NO: 5303 - skipped

SEQ ID NO: 5304 - protein, 10 aa, synthetic construct
  REGION 1..10: note = apitegromab light chain CDR3
AAWDDSLNGV

SEQ ID NO: 5305 - protein, 122 aa, synthetic construct
  REGION 1..122: note = aprutumab heavy chain V region
EVQLLESGGGLVQPGGSLRLSCAASGFTFSSYAMSWVRQAPGKGLEWVSAISGSGTSTYYADSVKGRFTISRDNSKNTLYLQMNSLRAEDTAVYYCARVRYNWNHGDWFDPWGQGTLVTVSS

SEQ ID NO: 5306 - protein, 8 aa, synthetic construct
  REGION 1..8: note = aprutumab heavy chain CDR1
GFTFSSYA

SEQ ID NO: 5307 - protein, 8 aa, synthetic construct
  REGION 1..8: note = aprutumab heavy chain CDR2
ISGSGTST

SEQ ID NO: 5308 - protein, 15 aa, synthetic construct
  REGION 1..15: note = aprutumab heavy chain CDR3
ARVRYNWNHGDWFDP

SEQ ID NO: 5309 - protein, 110 aa, synthetic construct
  REGION 1..110: note = aprutumab light chain V region
QSVLTQPPSASGTPGQRVTISCSGSSSNIGNNYVSWYQQLPGTAPKLLIYENYNRPAGVPDRFSGSKSGTSASLAISGLRSEDEADYYCSSWDDSLNYWVFGGGTKLTVL

SEQ ID NO: 5310 - protein, 8 aa, synthetic construct
  REGION 1..8: note = aprutumab light chain CDR1
SSNIGNNY

SEQ ID NO: 5311 - skipped

SEQ ID NO: 5312 - protein, 11 aa, synthetic construct
  REGION 1..11: note = aprutumab light chain CDR3
SSWDDSLNYWV

SEQ ID NO: 5313 - protein, 122 aa, synthetic construct; identical to SEQ ID NO: 5305
  REGION 1..122: note = aprutumab ixadotin heavy chain V region

SEQ ID NO: 5314 - protein, 8 aa, synthetic construct
  REGION 1..8: note = aprutumab ixadotin heavy chain CDR1
GFTFSSYA

SEQ ID NO: 5315 - protein, 8 aa, synthetic construct
  REGION 1..8: note = aprutumab ixadotin heavy chain CDR2
ISGSGTST

SEQ ID NO: 5316 - protein, 15 aa, synthetic construct
  REGION 1..15: note = aprutumab ixadotin heavy chain CDR3
ARVRYNWNHGDWFDP

SEQ ID NO: 5317 - protein, 110 aa, synthetic construct; identical to SEQ ID NO: 5309
  REGION 1..110: note = aprutumab ixadotin light chain V region

SEQ ID NO: 5318 - protein, 8 aa, synthetic construct
  REGION 1..8: note = aprutumab ixadotin light chain CDR1
SSNIGNNY

SEQ ID NO: 5319 - skipped

SEQ ID NO: 5320 - protein, 11 aa, synthetic construct
  REGION 1..11: note = aprutumab ixadotin light chain CDR3
SSWDDSLNYWV

SEQ ID NO: 5321 - protein, 118 aa, synthetic construct
  REGION 1..118: note = ascrinvacumab heavy chain V region
QVQLQESGPGLVKPSQTLSLTCTVSGGSISSGEYYWNWIRQHPGKGLEWIGYIYYSGSTYYNPSLKSRVTISVDTSKNQFSLKLSSVTAADTAVYYCARESVAGFDYWGQGTLVTVSS

SEQ ID NO: 5322 - protein, 10 aa, synthetic construct
  REGION 1..10: note = ascrinvacumab heavy chain CDR1
GGSISSGEYY

SEQ ID NO: 5323 - protein, 10 aa, synthetic construct
  REGION 1..10: note = ascrinvacumab heavy chain CDR2
IGYIYYSGST

SEQ ID NO: 5324 - protein, 10 aa, synthetic construct
  REGION 1..10: note = ascrinvacumab heavy chain CDR3
ARESVAGFDY

SEQ ID NO: 5325 - protein, 108 aa, synthetic construct
  REGION 1..108: note = ascrinvacumab light chain V region
EIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPITFGQGTRLEIK

SEQ ID NO: 5326 - protein, 7 aa, synthetic construct
  REGION 1..7: note = ascrinvacumab light chain CDR1
QSVSSSY

SEQ ID NO: 5327 - skipped

SEQ ID NO: 5328 - protein, 9 aa, synthetic construct
  REGION 1..9: note = ascrinvacumab light chain CDR3
QQYGSSPIT

SEQ ID NO: 5329 - protein, 121 aa, synthetic construct
  REGION 1..121: note = astegolimab heavy chain V region
EVQLVQSGAEVKKPGESLKISCKGSGYSFTNYWIGWVRQMPGKGLEWMGIIYPGNSDTRFSPSFQGQVTISADKSITTAYLQWSSLKASDTAMYYCARHGTSSDYYGLDVWGQGTTVTVSS

SEQ ID NO: 5330 - protein, 8 aa, synthetic construct
  REGION 1..8: note = astegolimab heavy chain CDR1
GYSFTNYW

SEQ ID NO: 5331 - protein, 8 aa, synthetic construct
  REGION 1..8: note = astegolimab heavy chain CDR2
IYPGNSDT

SEQ ID NO: 5332 - protein, 14 aa, synthetic construct
  REGION 1..14: note = astegolimab heavy chain CDR3
ARHGTSSDYYGLDV

SEQ ID NO: 5333 - protein, 107 aa, synthetic construct
  REGION 1..107: note = astegolimab light chain V region
DIQMTQSPSSLSASVGDRVTITCQASQDISNYLNWYQQKPGKAPKLLIYDASNLETGVPSRFSGSGSGTDFTFTISSLQPEDIATYYCQQDDNFPLTFGGGTKVEIK

SEQ ID NO: 5334 - protein, 6 aa, synthetic construct
  REGION 1..6: note = astegolimab light chain CDR1
QDISNY

SEQ ID NO: 5335 - skipped

SEQ ID NO: 5336 - protein, 9 aa, synthetic construct
  REGION 1..9: note = astegolimab light chain CDR3
QQDDNFPLT

SEQ ID NO: 5337 - protein, 118 aa, synthetic construct [sequence omitted]

SEQ ID NO: 5338 - protein, 8 aa, synthetic construct
  REGION 1..8: note = atezolizumab heavy chain CDR1
GFTFSDSW

SEQ ID NO: 5339 - protein, 8 aa, synthetic construct
  REGION 1..8: note = atezolizumab heavy chain CDR2
ISPYGGST

SEQ ID NO: 5340 - protein, 11 aa, synthetic construct
  REGION 1..11: note = atezolizumab heavy chain CDR3
ARRHWPGGFDY

SEQ ID NO: 5341 - protein, 107 aa, synthetic construct [sequence omitted]

SEQ ID NO: 5342 - protein, 6 aa, synthetic construct
  REGION 1..6: note = atezolizumab light chain CDR1
QDVSTA

SEQ ID NO: 5343 - skipped

SEQ ID NO: 5344 - protein, 9 aa, synthetic construct
  REGION 1..9: note = atezolizumab light chain CDR3
QQYLYHPAT

SEQ ID NO: 5345 - protein, 119 aa, synthetic construct
  REGION 1..119: note = atidortoxumab heavy chain V region
EVQLQESGPGLVRPSETLSLTCAVSGYSISSGMGWGWIRQPPGKGLEWIGSIDQRGSTYYNPSLKSRVTISVDTSKNQFSLKLSSVTAADTAVYYCARDAGHAVDMDVWGKGTTVTVSS

SEQ ID NO: 5346 - protein, 9 aa, synthetic construct
  REGION 1..9: note = atidortoxumab heavy chain CDR1
GYSISSGMG

SEQ ID NO: 5347 - protein, 10 aa, synthetic construct
  REGION 1..10: note = atidortoxumab heavy chain CDR2
IGSIDQRGST

SEQ ID NO: 5348 - protein, 9 aa, synthetic construct
  REGION 1..9: note = atidortoxumab heavy chain CDR3
AGHAVDMDV

SEQ ID NO: 5349 - protein, 107 aa, synthetic construct
  REGION 1..107: note = atidortoxumab light chain V region
DIQMTQSPSSVSASVGDRVTITCRASQGISRWLAWYQQKPGKAPKLLIYAASSLQSGVPSRFSGSGSGTDFTLTISSLQPEDFATYYCQQGYVFPLTFGGGTKVEIK

SEQ ID NO: 5350 - protein, 6 aa, synthetic construct
  REGION 1..6: note = atidortoxumab light chain CDR1
QGISRW

SEQ ID NO: 5351 - skipped

SEQ ID NO: 5352 - protein, 9 aa, synthetic construct
  REGION 1..9: note = atidortoxumab light chain CDR3
QQGYVFPLT

SEQ ID NO: 5353 - protein, 114 aa, synthetic construct
  REGION 1..114: note = atinumab heavy chain V region
EVQLVESGGGLVQPGGSLRLSCAASGFTFSNYWMSWVRQAPGKGLEWVATIKQDGSQKNYVDSVKGRFTISRDNAKNSLYLRLNSLRAEDTAVYYCATELFDLWGRGSLVTVSS

SEQ ID NO: 5354 - protein, 8 aa, synthetic construct
  REGION 1..8: note = atinumab heavy chain CDR1
GFTFSNYW

SEQ ID NO: 5355 - protein, 8 aa, synthetic construct
  REGION 1..8: note = atinumab heavy chain CDR2
IKQDGSQK

SEQ ID NO: 5356 - protein, 7 aa, synthetic construct
  REGION 1..7: note = atinumab heavy chain CDR3
ATELFDL

SEQ ID NO: 5357 - protein, 107 aa, synthetic construct
  REGION 1..107: note = atinumab light chain V region
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTKLEIK

SEQ ID NO: 5358 - protein, 6 aa, synthetic construct
  REGION 1..6: note = atinumab light chain CDR1
QSVSSY

SEQ ID NO: 5359 - skipped

SEQ ID NO: 5360 - protein, 9 aa, synthetic construct
  REGION 1..9: note = atinumab light chain CDR3
QQRSNWPIT

SEQ ID NO: 5361 - protein, 116 aa, synthetic construct
  REGION 1..116: note = atoltivimab heavy chain V region
QVQLVESGGGVVQPGRSLRLSCAASGFTFNNYGMHWVRQAPGMGLEWVAVIWHDGSDKYYADSVKGRFTISRDNSKNTLYLQMNSLRAEDTAVYYCARNWNLFDYWGQGTLVTVSS

SEQ ID NO: 5362 - protein, 8 aa, synthetic construct
  REGION 1..8: note = atoltivimab heavy chain CDR1
GFTFNNYG

SEQ ID NO: 5363 - protein, 8 aa, synthetic construct
  REGION 1..8: note = atoltivimab heavy chain CDR2
IWHDGSDK

SEQ ID NO: 5364 - protein, 9 aa, synthetic construct
  REGION 1..9: note = atoltivimab heavy chain CDR3
ARNWNLFDY

SEQ ID NO: 5365 - protein, 108 aa, synthetic construct
  REGION 1..108: note = atoltivimab light chain V region
DIQMTQSPSSLSASVGDRITITCRASQSISTYLHWYQQKPGKAPKLLIYAASTLQSGVPSRFSGSGSGTDFTLTISSLQPEDFATYYCQQSFSTPPINFGQGTKLEIK

SEQ ID NO: 5366 - protein, 6 aa, synthetic construct
  REGION 1..6: note = atoltivimab light chain CDR1
QSISTY

SEQ ID NO: 5367 - skipped

SEQ ID NO: 5368 - protein, 10 aa, synthetic construct
  REGION 1..10: note = atoltivimab light chain CDR3
QQSFSTPPIN

SEQ ID NO: 5369 - protein, 124 aa, synthetic construct
  REGION 1..124: note = avdoralimab heavy chain V region
EVQLVESGGGLVQPGGSLRLSCAASGFTFSSYVMHWVRQATGKGLEWVSAIDTGGGTYYADSVKGRFTISRENAKNSLYLQMNSLRAGDTAVYYCARDYYYYASGSYYKAFDIWGQGTMVTVSS

SEQ ID NO: 5370 - protein, 8 aa, synthetic construct
  REGION 1..8: note = avdoralimab heavy chain CDR1
GFTFSSYV

SEQ ID NO: 5371 - protein, 7 aa, synthetic construct
  REGION 1..7: note = avdoralimab heavy chain CDR2
IDTGGGT

SEQ ID NO: 5372 - protein, 11 aa, synthetic construct
  REGION 1..11: note = avdoralimab heavy chain CDR3
ASGSYYKAFDI

SEQ ID NO: 5373 - protein, 107 aa, synthetic construct
  REGION 1..107: note = avdoralimab light chain V region
EIVLTQSPGTLSLSPGERATLSCRASQSVSSRYLAWYQQKPGQAPRLLIYGASSRATGIPDRFSGSGSGTDFTLTISRLEPEDFAVYYCQQYGSPLTFGQGTKLEIK

SEQ ID NO: 5374 - protein, 7 aa, synthetic construct
  REGION 1..7: note = avdoralimab light chain CDR1
QSVSSRY

SEQ ID NO: 5375 - skipped

SEQ ID NO: 5376 - protein, 8 aa, synthetic construct
  REGION 1..8: note = avdoralimab light chain CDR3
QQYGSPLT

SEQ ID NO: 5377 - protein, 120 aa, synthetic construct
  REGION 1..120: note = avelumab heavy chain V region
EVQLLESGGGLVQPGGSLRLSCAASGFTFSSYIMMWVRQAPGKGLEWVSSIYPSGGITFYADTVKGRFTISRDNSKNTLYLQMNSLRAEDTAVYYCARIKLGTVTTVDYWGQGTLVTVSS

SEQ ID NO: 5378 - protein, 8 aa, synthetic construct
  REGION 1..8: note = avelumab heavy chain CDR1
GFTFSSYI

SEQ ID NO: 5379 - protein, 8 aa, synthetic construct
  REGION 1..8: note = avelumab heavy chain CDR2
IYPSGGIT

SEQ ID NO: 5380 - protein, 13 aa, synthetic construct
  REGION 1..13: note = avelumab heavy chain CDR3
ARIKLGTVTTVDY

SEQ ID NO: 5381 - protein, 110 aa, synthetic construct
  REGION 1..110: note = avelumab light chain V region
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL

SEQ ID NO: 5382 - protein, 9 aa, synthetic construct
  REGION 1..9: note = avelumab light chain CDR1
SSDVGGYNY

SEQ ID NO: 5383 - skipped

SEQ ID NO: 5384 - protein, 10 aa, synthetic construct
  REGION 1..10: note = avelumab light chain CDR3
SSYTSSSTRV

SEQ ID NO: 5385 - protein, 113 aa, synthetic construct
  REGION 1..113: note = balstilimab heavy chain V region
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCASNGDHWGQGTLVTVSS

SEQ ID NO: 5386 - protein, 8 aa, synthetic construct
  REGION 1..8: note = balstilimab heavy chain CDR1
GFTFSSYG

SEQ ID NO: 5387 - protein, 8 aa, synthetic construct
  REGION 1..8: note = balstilimab heavy chain CDR2
IWYDGSNK

SEQ ID NO: 5388 - protein, 6 aa, synthetic construct
  REGION 1..6: note = balstilimab heavy chain CDR3
ASNGDH

SEQ ID NO: 5389 - protein, 107 aa, synthetic construct
  REGION 1..107: note = balstilimab light chain V region
EIVMTQSPATLSVSPGERATLSCRASQSVSSNLAWYQQKPGQAPRLLIYGASTRATGIPARFSGSGSGTEFTLTISSLQSEDFAVYYCQQYNNWPRTFGQGTKVEIK

SEQ ID NO: 5390 - protein, 6 aa, synthetic construct
  REGION 1..6: note = balstilimab light chain CDR1
QSVSSN

SEQ ID NO: 5391 - skipped

SEQ ID NO: 5392 - protein, 9 aa, synthetic construct
  REGION 1..9: note = balstilimab light chain CDR3
QQYNNWPRT

SEQ ID NO: 5393 - protein, 125 aa, synthetic construct; identical to SEQ ID NO: 440
  REGION 1..125: note = bamlanivimab heavy chain V region

SEQ ID NO: 5394 - protein, 8 aa, synthetic construct
  REGION 1..8: note = bamlanivimab heavy chain CDR1
GGTFSNYA

SEQ ID NO: 5395 - protein, 9 aa, synthetic construct
  REGION 1..9: note = bamlanivimab heavy chain CDR2
IIPILGIAN

SEQ ID NO: 5396 - protein, 18 aa, synthetic construct
  REGION 1..18: note = bamlanivimab heavy chain CDR3
ARGYYEARHYYYYYAMDV

SEQ ID NO: 5397 - protein, 107 aa, synthetic construct; identical to SEQ ID NO: 439
  REGION 1..107: note = bamlanivimab light chain V region

SEQ ID NO: 5398 - protein, 6 aa, synthetic construct
  REGION 1..6: note = bamlanivimab light chain CDR1
QSISSY

SEQ ID NO: 5399 - skipped

SEQ ID NO: 5400 - protein, 9 aa, synthetic construct
  REGION 1..9: note = bamlanivimab light chain CDR3
QQSYSTPRT

SEQ ID NO: 5401 - protein, 120 aa, synthetic construct
  REGION 1..120: note = bapotulimab heavy chain V region
QVQLVQSGAEVKKPGSSVKVSCKASGGTFSSYAISWVRQAPGQGLEWMGGIIPILGIANYAQKFQGRVTITADKSTSTAYMELSSLRSEDTAVYYCARGRLPYGDFWDSWGQGTLVTVSS

SEQ ID NO: 5402 - protein, 8 aa, synthetic construct
  REGION 1..8: note = bapotulimab heavy chain CDR1
GGTFSSYA

SEQ ID NO: 5403 - protein, 8 aa, synthetic construct
  REGION 1..8: note = bapotulimab heavy chain CDR2
IIPILGIA

SEQ ID NO: 5404 - protein, 13 aa, synthetic construct
  REGION 1..13: note = bapotulimab heavy chain CDR3
ARGRLPYGDFWDS

SEQ ID NO: 5405 - protein, 112 aa, synthetic construct
  REGION 1..112: note = bapotulimab light chain V region
DIVMTQSPLSLPVTPGEPASISCRSSQSLLYSNGYNYLDWYLQKPGQSPQLLIYLGSNRASGVPDRFSGSGSGTDFTLKISRVEAEDVGVYYCMQALQTPLTFGGGTKLEIR

SEQ ID NO: 5406 - protein, 11 aa, synthetic construct
  REGION 1..11: note = bapotulimab light chain CDR1
QSLLYSNGYNY

SEQ ID NO: 5407 - skipped

SEQ ID NO: 5408 - protein, 9 aa, synthetic construct
  REGION 1..9: note = bapotulimab light chain CDR3
MQALQTPLT

SEQ ID NO: 5409 - protein, 121 aa, synthetic construct
  REGION 1..121: note = barecetamab heavy chain V region
EVQLLESGGGLVQPGGSLRLSCAASGFTFSDYDMSWVRQAPGKGLEWVSTIDLDSGSIYYADSVQGRFTISRDNSKNTLYLQMNSLRAEDTAVYYCAKDLHMGPEGPFDYWGQGTLVTVSS

SEQ ID NO: 5410 - protein, 8 aa, synthetic construct
  REGION 1..8: note = barecetamab heavy chain CDR1
GFTFSDYD

SEQ ID NO: 5411 - protein, 8 aa, synthetic construct
  REGION 1..8: note = barecetamab heavy chain CDR2
IDLDSGSI

SEQ ID NO: 5412 - protein, 14 aa, synthetic construct
  REGION 1..14: note = barecetamab heavy chain CDR3
AKDLHMGPEGPFDY

SEQ ID NO: 5413 - protein, 110 aa, synthetic construct
  REGION 1..110: note = barecetamab light chain V region
QSVLTQPPSASGTPGQRVTISCSGSSSNIGSNSVSWYQQLPGTAPKLLIYSDNHRPSGVPDRFSGSKSGTSASLAISGLRSEDEADYYCQGWDTSLSGHVFGGGTKLTVL

SEQ ID NO: 5414 - protein, 8 aa, synthetic construct
  REGION 1..8: note = barecetamab light chain CDR1
SSNIGSNS

SEQ ID NO: 5415 - skipped

SEQ ID NO: 5416 - protein, 11 aa, synthetic construct
  REGION 1..11: note = barecetamab light chain CDR3
QGWDTSLSGHV

SEQ ID NO: 5417 - protein, 121 aa, synthetic construct
  REGION 1..121: note = batoclimab heavy chain V region
QLLLQESGPGLVKPSETLSLTCTVSGGSLSSSFSYWVWIRQPPGKGLEWIGTIYYSGNTYYNPSLKSRLTISVDTSKNHFSLKLSSVTAADTAVYYCARRAGILTGYLDSWGQGTLVTVSS

SEQ ID NO: 5418 - protein, 10 aa, synthetic construct
  REGION 1..10: note = batoclimab heavy chain CDR1
GGSLSSSFSY

SEQ ID NO: 5419 - protein, 8 aa, synthetic construct
  REGION 1..8: note = batoclimab heavy chain CDR2
TIYYSGNT

SEQ ID NO: 5420 - protein, 13 aa, synthetic construct
  REGION 1..13: note = batoclimab heavy chain CDR3
ARRAGILTGYLDS

SEQ ID NO: 5421 - protein, 108 aa, synthetic construct
  REGION 1..108: note = batoclimab light chain V region
SYVLTQSPSVSVAPGQTARITCGGNNIGSKSVHWYQQKPGQAPVLVVYDDSDRPSGIPERFSASNSGNTATLTISRVEAGDEADYYCQVWDSSSDHVVFGGGTKLTVL

SEQ ID NO: 5422 - protein, 6 aa, synthetic construct
  REGION 1..6: note = batoclimab light chain CDR1
NIGSKS

SEQ ID NO: 5423 - skipped

SEQ ID NO: 5424 - protein, 11 aa, synthetic construct
  REGION 1..11: note = batoclimab light chain CDR3
QVWDSSSDHVV

SEQ ID NO: 5425 - protein, 117 aa, synthetic construct
  REGION 1..117: note = befovacimab heavy chain V region
EVQLVESGGGLVQPGGSLRLSCAASGFTFSSYGMDWVRQAPGKGLEWVSSIRGSRGSTYYADSVKGRFTISRDNSKNTLYLQMNSLRAEDTAVYYCARLYRYWFDYWGQGTLVTVSS

SEQ ID NO: 5426 - protein, 8 aa, synthetic construct
  REGION 1..8: note = befovacimab heavy chain CDR1
GFTFSSYG

SEQ ID NO: 5427 - protein, 8 aa, synthetic construct
  REGION 1..8: note = befovacimab heavy chain CDR2
IRGSRGST

SEQ ID NO: 5428 - protein, 10 aa, synthetic construct
  REGION 1..10: note = befovacimab heavy chain CDR3
ARLYRYWFDY

SEQ ID NO: 5429 - protein, 106 aa, synthetic construct
  REGION 1..106: note = befovacimab light chain V region
SYELTQPPSVSVSPGQTARITCSGDNLPKYYAHWYQQKPGQAPVVVIFYDVNRPSGIPERFSGSNSGNTATLTISGTQAMDEADYYCQAWWSSTPVFGGGTKLTVL

SEQ ID NO: 5430 - protein, 6 aa, synthetic construct
  REGION 1..6: note = befovacimab light chain CDR1
NLPKYY

SEQ ID NO: 5431 - skipped

SEQ ID NO: 5432 - protein, 8 aa, synthetic construct
  REGION 1..8: note = befovacimab light chain CDR3
AWWSSTPV

SEQ ID NO: 5433 - protein, 121 aa, synthetic construct
  REGION 1..121: note = belantamab heavy chain V region
QVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSS

SEQ ID NO: 5434 - protein, 8 aa, synthetic construct
  REGION 1..8: note = belantamab heavy chain CDR1
GGTFSNYW

SEQ ID NO: 5435 - protein, 8 aa, synthetic construct
  REGION 1..8: note = belantamab heavy chain CDR2
TYRGHSDT

SEQ ID NO: 5436 - protein, 14 aa, synthetic construct
  REGION 1..14: note = belantamab heavy chain CDR3
ARGAIYDGYDVLDN

SEQ ID NO: 5437 - protein, 107 aa, synthetic construct
  REGION 1..107: note = belantamab light chain V region
DIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIK

SEQ ID NO: 5438 - protein, 6 aa, synthetic construct
  REGION 1..6: note = belantamab light chain CDR1
QDISNY

SEQ ID NO: 5439 - skipped

SEQ ID NO: 5440 - protein, 9 aa, synthetic construct
  REGION 1..9: note = belantamab light chain CDR3
QQYRKLPWT

SEQ ID NO: 5441 - protein, 123 aa, synthetic construct
  REGION 1..123: note = belimumab heavy chain V region
QVQLQQSGAEVKKPGSSVRVSCKASGGTFNNNAINWVRQAPGQGLEWMGGIIPMFGTAKYSQNFQGRVAITADESTGTASMELSSLRSEDTAVYYCARSRDLLLFPHHALSPWGRGTMVTVSS

SEQ ID NO: 5442 - protein, 8 aa, synthetic construct
  REGION 1..8: note = belimumab heavy chain CDR1
GGTFNNNA

SEQ ID NO: 5443 - protein, 8 aa, synthetic construct
  REGION 1..8: note = belimumab heavy chain CDR2
IIPMFGTA

SEQ ID NO: 5444 - protein, 16 aa, synthetic construct
  REGION 1..16: note = belimumab heavy chain CDR3
ARSRDLLLFPHHALSP

SEQ ID NO: 5445 - protein, 108 aa, synthetic construct
  REGION 1..108: note = belimumab light chain V region
SSELTQDPAVSVALGQTVRVTCQGDSLRSYYASWYQQKPGQAPVLVIYGKNNRPSGIPDRFSGSSSGNTASLTITGAQAEDEADYYCSSRDSSGNHWVFGGGTELTVL

SEQ ID NO: 5446 - protein, 6 aa, synthetic construct
  REGION 1..6: note = belimumab light chain CDR1
SLRSYY

SEQ ID NO: 5447 - skipped

SEQ ID NO: 5448 - protein, 11 aa, synthetic construct
  REGION 1..11: note = belimumab light chain CDR3
SSRDSSGNHWV

SEQ ID NO: 5449 - protein, 121 aa, synthetic construct [sequence omitted]

SEQ ID NO: 5450 - protein, 8 aa, synthetic construct
  REGION 1..8: note = benralizumab heavy chain CDR1
GYTFTSYV

SEQ ID NO: 5451 - protein, 8 aa, synthetic construct
  REGION 1..8: note = benralizumab heavy chain CDR2
INPYNDGT

SEQ ID NO: 5452 - protein, 14 aa, synthetic construct
  REGION 1..14: note = benralizumab heavy chain CDR3
GREGIRYYGLLGDY

SEQ ID NO: 5453 - protein, 107 aa, synthetic construct [sequence omitted]

SEQ ID NO: 5454 - protein, 6 aa, synthetic construct
  REGION 1..6: note = benralizumab light chain CDR1
EDIINY

SEQ ID NO: 5455 - skipped

SEQ ID NO: 5456 - protein, 9 aa, synthetic construct
  REGION 1..9: note = benralizumab light chain CDR3
QQGYTLPYT

SEQ ID NO: 5457 - protein, 128 aa, synthetic construct
  REGION 1..128: note = bentracimab heavy chain V region
QVQLQESGAEVKKPGSSVRVSCKASGGTFDSYSIHWVRQAPGQGLEWMGGIIPAFGTLSSAQDFQARVTISADKSTSTAYMELSGLRSEDTAVYYCARGSFDYYFWSASHPPNDALAIWGQGTLVTVS

SEQ ID NO: 5458 - protein, 8 aa, synthetic construct
  REGION 1..8: note = bentracimab heavy chain CDR1
GGTFDSYS

SEQ ID NO: 5459 - protein, 8 aa, synthetic construct
  REGION 1..8: note = bentracimab heavy chain CDR2
IIPAFGTL

SEQ ID NO: 5460 - protein, 22 aa, synthetic construct
  REGION 1..22: note = bentracimab heavy chain CDR3
ARGSFDYYFWSASHPPNDALAI

SEQ ID NO: 5461 - protein, 110 aa, synthetic construct
  REGION 1..110: note = bentracimab light chain V region
QSVVTQPPSVSAAPGQKVTISCSGSNSDIGNNYVSWYQQLPGTAPKLLIYDNNKRPSGIPDRFSGSKSGTSATLAITGLQAGDEADYYCGTWLYDRAVGLFGGGTKVTVL

SEQ ID NO: 5462 - protein, 8 aa, synthetic construct
  REGION 1..8: note = bentracimab light chain CDR1
NSDIGNNY

SEQ ID NO: 5463 - skipped

SEQ ID NO: 5464 - protein, 11 aa, synthetic construct
  REGION 1..11: note = bentracimab light chain CDR3
GTWLYDRAVGL

SEQ ID NO: 5465 - protein, 119 aa, synthetic construct
  REGION 1..119: note = berlimatoxumab heavy chain V region
ELQLQESGPGLVKPSETLSLTCTVSGGSISSGSYYWDWIRQPPGKGLEWIGNIYKSGSTYYNPSLKSRVTISVDTSKNQFSLKLSSVTAADTAVYYCARERGMHYMDVWGKGTTVTVSS

SEQ ID NO: 5466 - protein, 10 aa, synthetic construct
  REGION 1..10: note = berlimatoxumab heavy chain CDR1
GGSISSGSYY

SEQ ID NO: 5467 - protein, 7 aa, synthetic construct
  REGION 1..7: note = berlimatoxumab heavy chain CDR2
IYKSGST

SEQ ID NO: 5468 - protein, 11 aa, synthetic construct
  REGION 1..11: note = berlimatoxumab heavy chain CDR3
ARERGMHYMDV

SEQ ID NO: 5469 - protein, 107 aa, synthetic construct
  REGION 1..107: note = berlimatoxumab light chain V region
DIQMTQSPSSLSASVGDRVTITCRASQSINSYLNWYQQKPGKAPKLLIYAASSLQSGVPSRFSGSGSGTDFTLTISSLQPEDFATYYCQQQFDPPFTFGGGTKVEIK

SEQ ID NO: 5470 - protein, 6 aa, synthetic construct
  REGION 1..6: note = berlimatoxumab light chain CDR1
QSINSY

SEQ ID NO: 5471 - skipped

SEQ ID NO: 5472 - protein, 8 aa, synthetic construct
  REGION 1..8: note = berlimatoxumab light chain CDR3
QQFDPPFT

SEQ ID NO: 5473 - protein, 117 aa, synthetic construct
  REGION 1..117: note = bersanlimab heavy chain V region
EVQLLESGGGLVQPGGSLRLSCAASGFTFSNAWMSWVRQAPGKGLEWVAFIWYDGSNKYYADSVKGRFTISRDNSKNTLYLQMNSLRAEDTAVYYCARYSGWYFDYWGQGTLVTVSS

SEQ ID NO: 5474 - protein, 8 aa, synthetic construct
  REGION 1..8: note = bersanlimab heavy chain CDR1
GFTFSNAW

SEQ ID NO: 5475 - protein, 8 aa, synthetic construct
  REGION 1..8: note = bersanlimab heavy chain CDR2
IWYDGSNK

SEQ ID NO: 5476 - protein, 10 aa, synthetic construct
  REGION 1..10: note = bersanlimab heavy chain CDR3
ARYSGWYFDY

SEQ ID NO: 5477 - protein, 111 aa, synthetic construct
  REGION 1..111: note = bersanlimab light chain V region
QSVLTQPPSASGTPGQRVTISCTGSSSNIGAGYDVHWYQQLPGTAPKLLIYDNNNRPSGVPDRFSGSKSGTSASLAISGLRSEDEADYYCQSYDSSLSAWLFGGGTKLTVL

SEQ ID NO: 5478 - protein, 9 aa, synthetic construct
  REGION 1..9: note = bersanlimab light chain CDR1
SSNIGAGYD

SEQ ID NO: 5479 - skipped

SEQ ID NO: 5480 - protein, 10 aa, synthetic construct
  REGION 1..10: note = bersanlimab light chain CDR3
QSYDSSLSAW

SEQ ID NO: 5481 - protein, 123 aa, synthetic construct [sequence omitted]

SEQ ID NO: 5482 - protein, 8 aa, synthetic construct
  REGION 1..8: note = bevacizumab heavy chain CDR1
GYTFTNYG

SEQ ID NO: 5483 - protein, 8 aa, synthetic construct
  REGION 1..8: note = bevacizumab heavy chain CDR2
INTYTGEP

SEQ ID NO: 5484 - protein, 16 aa, synthetic construct
  REGION 1..16: note = bevacizumab heavy chain CDR3
AKYPHYYGSSHWYFDV

SEQ ID NO: 5485 - protein, 107 aa, synthetic construct [sequence omitted]

SEQ ID NO: 5486 - protein, 6 aa, synthetic construct
  REGION 1..6: note = bevacizumab light chain CDR1
QDISNY

SEQ ID NO: 5487 - skipped

SEQ ID NO: 5488 - protein, 9 aa, synthetic construct
  REGION 1..9: note = bevacizumab light chain CDR3
QQYSTVPWT

SEQ ID NO: 5489 - protein, 119 aa, synthetic construct
  REGION 1..119: note = bezlotoxumab heavy chain V region
EVQLVQSGAEVKKSGESLKISCKGSGYSFTSYWIGWVRQMPGKGLEWMGIFYPGDSSTRYSPSFQGQVTISADKSVNTAYLQWSSLKASDTAMYYCARRRNWGNAFDIWGQGTMVTVSS

SEQ ID NO: 5490 - protein, 7 aa, synthetic construct
  REGION 1..7: note = bezlotoxumab heavy chain CDR1
YSFTSYW

SEQ ID NO: 5491 - protein, 9 aa, synthetic construct
  REGION 1..9: note = bezlotoxumab heavy chain CDR2
IFYPGDSST

SEQ ID NO: 5492 - protein, 12 aa, synthetic construct
  REGION 1..12: note = bezlotoxumab heavy chain CDR3
ARRRNWGNAFDI

SEQ ID NO: 5493 - protein, 108 aa, synthetic construct
  REGION 1..108: note = bezlotoxumab light chain V region
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSTWTFGQGTKVEIK

SEQ ID NO: 5494 - protein, 7 aa, synthetic construct
  REGION 1..7: note = bezlotoxumab light chain CDR1
QSVSSSY

SEQ ID NO: 5495 - skipped

SEQ ID NO: 5496 - protein, 9 aa, synthetic construct
  REGION 1..9: note = bezlotoxumab light chain CDR3
QQYGSSTWT

SEQ ID NO: 5497 - protein, 115 aa, synthetic construct [sequence omitted]

SEQ ID NO: 5498 - protein, 8 aa, synthetic construct
  REGION 1..8: note = bimagrumab heavy chain CDR1
GYTFTSSY

SEQ ID NO: 5499 - protein, 8 aa, synthetic construct
  REGION 1..8: note = bimagrumab heavy chain CDR2
INPVSGST

SEQ ID NO: 5500 - protein, 8 aa, synthetic construct
  REGION 1..8: note = bimagrumab heavy chain CDR3
ARGGWFDY

SEQ ID NO: 5501 - protein, 111 aa, synthetic construct [sequence omitted]

SEQ ID NO: 5502 - protein, 9 aa, synthetic construct
  REGION 1..9: note = bimagrumab light chain CDR1
SSDVGSYNY

SEQ ID NO: 5503 - skipped

SEQ ID NO: 5504 - protein, 11 aa, synthetic construct
  REGION 1..11: note = bimagrumab light chain CDR3
GTFAGGSYYGV

SEQ ID NO: 5505 - protein, 125 aa, synthetic construct
  REGION 1..125: note = bimekizumab heavy chain V region
EVQLVESGGGLVQPGGSLRLSCAASGFTFSDYNMAWVRQAPGKGLEWVATITYEGRNTYYRDSVKGRFTISRDNAKNSLYLQMNSLRAEDTAVYYCASPPQYYEGSIYRLWFAHWGQGTLVTVSS

SEQ ID NO: 5506 - protein, 8 aa, synthetic construct
  REGION 1..8: note = bimekizumab heavy chain CDR1
GFTFSDYN

SEQ ID NO: 5507 - protein, 8 aa, synthetic construct
  REGION 1..8: note = bimekizumab heavy chain CDR2
ITYEGRNT

SEQ ID NO: 5508 - protein, 18 aa, synthetic construct
  REGION 1..18: note = bimekizumab heavy chain CDR3
ASPPQYYEGSIYRLWFAH

SEQ ID NO: 5509 - protein, 107 aa, synthetic construct
  REGION 1..107: note = bimekizumab light chain V region
AIQLTQSPSSLSASVGDRVTITCRADESVRTLMHWYQQKPGKAPKLLIYLVSNSEIGVPDRFSGSGSGTDFRLTISSLQPEDFATYYCQQTWSDPWTFGQGTKVEIK

SEQ ID NO: 5510 - protein, 6 aa, synthetic construct
  REGION 1..6: note = bimekizumab light chain CDR1
ESVRTL

SEQ ID NO: 5511 - skipped

SEQ ID NO: 5512 - protein, 9 aa, synthetic construct
  REGION 1..9: note = bimekizumab light chain CDR3
QQTWSDPWT

SEQ ID NO: 5513 - protein, 120 aa, synthetic construct; identical to SEQ ID NO: 5377
  REGION 1..120: note = bintrafusp alfa heavy chain V region

SEQ ID NO: 5514 - protein, 8 aa, synthetic construct
  REGION 1..8: note = bintrafusp alfa heavy chain CDR1
GFTFSSYI

SEQ ID NO: 5515 - protein, 8 aa, synthetic construct
  REGION 1..8: note = bintrafusp alfa heavy chain CDR2
IYPSGGIT

SEQ ID NO: 5516 - protein, 13 aa, synthetic construct
  REGION 1..13: note = bintrafusp alfa heavy chain CDR3
ARIKLGTVTTVDY

SEQ ID NO: 5517 - protein, 110 aa, synthetic construct; identical to SEQ ID NO: 5381
  REGION 1..110: note = bintrafusp alfa light chain V region

SEQ ID NO: 5518 - protein, 9 aa, synthetic construct
  REGION 1..9: note = bintrafusp alfa light chain CDR1
SSDVGGYNY

SEQ ID NO: 5519 - skipped

SEQ ID NO: 5520 - protein, 11 aa, synthetic construct
  REGION 1..11: note = bintrafusp alfa light chain CDR3
SSYTSSSTRVF

SEQ ID NO: 5521 - protein, 121 aa, synthetic construct
  REGION 1..121: note = bleselumab heavy chain V region
QLQLQESGPGLLKPSETLSLTCTVSGGSISSPGYYGGWIRQPPGKGLEWIGSIYKSGSTYHNPSLKSRVTISVDTSKNQFSLKLSSVTAADTAVYYCTRPVVRYFGWFDPWGQGTLVTVSS

SEQ ID NO: 5522 - protein, 9 aa, synthetic construct
  REGION 1..9: note = bleselumab heavy chain CDR1
GGSISSPGY

SEQ ID NO: 5523 - protein, 7 aa, synthetic construct
  REGION 1..7: note = bleselumab heavy chain CDR2
IYKSGST

SEQ ID NO: 5524 - protein, 13 aa, synthetic construct
  REGION 1..13: note = bleselumab heavy chain CDR3
TRPVVRYFGWFDP

SEQ ID NO: 5525 - protein, 106 aa, synthetic construct
  REGION 1..106: note = bleselumab light chain V region
AIQLTQSPSSLSASVGDRVTITCRASQGISSALAWYQQKPGKAPKLLIYDASNLESGVPSRFSGSGSGTDFTLTISSLQPEDFATYYCQQFNSYPTFGQGTKVEIK

SEQ ID NO: 5526 - protein, 6 aa, synthetic construct
  REGION 1..6: note = bleselumab light chain CDR1
QGISSA

SEQ ID NO: 5527 - skipped

SEQ ID NO: 5528 - protein, 8 aa, synthetic construct
  REGION 1..8: note = bleselumab light chain CDR3
QQFNSYPT

SEQ ID NO: 5529 - protein, 118 aa, synthetic construct
  REGION 1..118: note = botensilimab heavy chain V region
EVQLVESGGGLVKPGGSLRLSCAASGFTFSSYSMNWVRQAPGKGLEWVSSISSSSSYIYYAESVKGRFTISRDNAKNSLYLQMNSLRAEDTAVYYCARVGLFGPFDIWGQGTLVTVSS

SEQ ID NO: 5530 - protein, 8 aa, synthetic construct
  REGION 1..8: note = botensilimab heavy chain CDR1
GFTFSSYS

SEQ ID NO: 5531 - protein, 8 aa, synthetic construct
  REGION 1..8: note = botensilimab heavy chain CDR2
ISSSSSYI

SEQ ID NO: 5532 - protein, 11 aa, synthetic construct
  REGION 1..11: note = botensilimab heavy chain CDR3
ARVGLFGPFDI

SEQ ID NO: 5533 - protein, 107 aa, synthetic construct
  REGION 1..107: note = botensilimab light chain V region
EIVLTQSPGTLSLSPGERATLSCRASQSVSRYLGWYQQKPGQAPRLLIYGASTRATGIPDRFSGSGSGTDFTLTITRLEPEDFAVYYCQQYGSSPWTFGQGTKVEIK

SEQ ID NO: 5534 - protein, 6 aa, synthetic construct
  REGION 1..6: note = botensilimab light chain CDR1
QSVSRY

SEQ ID NO: 5535 - skipped

SEQ ID NO: 5536 - protein, 9 aa, synthetic construct
  REGION 1..9: note = botensilimab light chain CDR3
QQYGSSPWT

SEQ ID NO: 5537 - protein, 124 aa, synthetic construct
  REGION 1..124: note = brazikumab heavy chain V region
QVQLVESGGGVVQPGRSLRLSCAASGFTFSSYGMHWVRQAPGKGLEWVAVIWYDGSNEYYADSVKGRFTISRDNSKNTLYLQMNSLRAEDTAVYYCARDRGYTSSWYPDAFDIWGQGTMVTVSS

SEQ ID NO: 5538 - protein, 8 aa, synthetic construct
  REGION 1..8: note = brazikumab heavy chain CDR1
GFTFSSYG

SEQ ID NO: 5539 - protein, 8 aa, synthetic construct
  REGION 1..8: note = brazikumab heavy chain CDR2
IWYDGSNE

SEQ ID NO: 5540 - protein, 17 aa, synthetic construct
  REGION 1..17: note = brazikumab heavy chain CDR3
ARDRGYTSSWYPDAFDI

SEQ ID NO: 5541 - protein, 111 aa, synthetic construct
  REGION 1..111: note = brazikumab light chain V region
QSVLTQPPSVSGAPGQRVTISCTGSSSNTGAGYDVHWYQQVPGTAPKLLIYGSGNRPSGVPDRFSGSKSGTSASLAITGLQAEDEADYYCQSYDSSLSGWVFGGGTRLTVL

SEQ ID NO: 5542 - protein, 10 aa, synthetic construct
  REGION 1..10: note = brazikumab light chain CDR1
SSSNTGAGYD

SEQ ID NO: 5543 - skipped

SEQ ID NO: 5544 - protein, 11 aa, synthetic construct
  REGION 1..11: note = brazikumab light chain CDR3
QSYDSSLSGWV

SEQ ID NO: 5545 - protein, 117 aa, synthetic construct
  REGION 1..117: note = brentuximab vedotin heavy chain V region
QIQLQQSGPEVVKPGASVKISCKASGYTFTDYYITWVKQKPGQGLEWIGWIYPGSGNTKYNEKFKGKATLTVDTSSSTAFMQLSSLTSEDTAVYFCANYGNYWFAYWGQGTQVTVSA

SEQ ID NO: 5546 - protein, 8 aa, synthetic construct
  REGION 1..8: note = brentuximab vedotin heavy chain CDR1
GYTFTDYY

SEQ ID NO: 5547 - protein, 8 aa, synthetic construct
  REGION 1..8: note = brentuximab vedotin heavy chain CDR2
IYPGSGNT

SEQ ID NO: 5548 - protein, 10 aa, synthetic construct
  REGION 1..10: note = brentuximab vedotin heavy chain CDR3
ANYGNYWFAY

SEQ ID NO: 5549 - protein, 111 aa, synthetic construct
  REGION 1..111: note = brentuximab vedotin light chain V region
DIVLTQSPASLAVSLGQRATISCKASQSVDFDGDSYMNWYQQKPGQPPKVLIYAASNLESGIPARFSGSGSGTDFTLNIHPVEEEDAATYYCQQSNEDPWTFGGGTKLEIK

SEQ ID NO: 5550 - protein, 10 aa, synthetic construct
  REGION 1..10: note = brentuximab vedotin light chain CDR1
QSVDFDGDSY

SEQ ID NO: 5551 - skipped

SEQ ID NO: 5552 - protein, 9 aa, synthetic construct
  REGION 1..9: note = brentuximab vedotin light chain CDR3
QQSNEDPWT

SEQ ID NO: 5553 - protein, 115 aa, synthetic construct [sequence omitted]

SEQ ID NO: 5554 - protein, 8 aa, synthetic construct
  REGION 1..8: note = briakinumab heavy chain CDR1
GFTFSSYG

SEQ ID NO: 5555 - protein, 8 aa, synthetic construct
  REGION 1..8: note = briakinumab heavy chain CDR2
IRYDGSNK

SEQ ID NO: 5556 - protein, 8 aa, synthetic construct
  REGION 1..8: note = briakinumab heavy chain CDR3
KTHGSHDN

SEQ ID NO: 5557 - protein, 111 aa, synthetic construct [sequence omitted]

SEQ ID NO: 5558-5560 - skipped (3 entries)

SEQ ID NO: 5561 - protein, 116 aa, synthetic construct
  REGION 1..116: note = brodalumab heavy chain V region
QVQLVQSGAEVKKPGASVKVSCKASGYTFTRYGISWVRQAPGQGLEWMGWISTYSGNTNYAQKLQGRVTMTTDTSTSTAYMELRSLRSDDTAVYYCARRQLYFDYWGQGTLVTVSS

SEQ ID NO: 5562 - protein, 8 aa, synthetic construct
  REGION 1..8: note = brodalumab heavy chain CDR1
GYTFTRYG

SEQ ID NO: 5563 - protein, 8 aa, synthetic construct
  REGION 1..8: note = brodalumab heavy chain CDR2
ISTYSGNT

SEQ ID NO: 5564 - protein, 9 aa, synthetic construct
  REGION 1..9: note = brodalumab heavy chain CDR3
ARRQLYFDY

SEQ ID NO: 5565 - protein, 107 aa, synthetic construct
  REGION 1..107: note = brodalumab light chain V region
EIVMTQSPATLSVSPGERATLSCRASQSVSSNLAWFQQKPGQAPRPLIYDASTRATGVPARFSGSGSGTDFTLTISSLQSEDFAVYYCQQYDNWPLTFGGGTKVEIK

SEQ ID NO: 5566 - protein, 6 aa, synthetic construct
  REGION 1..6: note = brodalumab light chain CDR1
QSVSSN

SEQ ID NO: 5567 - skipped

SEQ ID NO: 5568 - protein, 9 aa, synthetic construct
  REGION 1..9: note = brodalumab light chain CDR3
QQYDNWPLT

SEQ ID NO: 5569 - protein, 120 aa, synthetic construct
  REGION 1..120: note = brolucizumab heavy chain V region
EVQLVESGGGLVQPGGSLRLSCTASGFSLTDYYYMTWVRQAPGKGLEWVGFIDPDDDPYYATWAKGRFTISRDNSKNTLYLQMNSLRAEDTAVYYCAGGDHNSGWGLDIWGQGTLVTVSS

SEQ ID NO: 5570 - protein, 9 aa, synthetic construct
  REGION 1..9: note = brolucizumab heavy chain CDR1
GFSLTDYYY

SEQ ID NO: 5571 - protein, 7 aa, synthetic construct
  REGION 1..7: note = brolucizumab heavy chain CDR2
IDPDDDP

SEQ ID NO: 5572 - protein, 13 aa, synthetic construct
  REGION 1..13: note = brolucizumab heavy chain CDR3
AGGDHNSGWGLDI

SEQ ID NO: 5573 - protein, 110 aa, synthetic construct
  REGION 1..110: note = brolucizumab light chain V region
EIVMTQSPSTLSASVGDRVIITCQASEIIHSWLAWYQQKPGKAPKLLIYLASTLASGVPSRFSGSGSGAEFTLTISSLQPDDFATYYCQNVYLASTNGANFGQGTKLTVL

SEQ ID NO: 5574 - protein, 6 aa, synthetic construct
  REGION 1..6: note = brolucizumab light chain CDR1
EIIHSW

SEQ ID NO: 5575 - skipped

SEQ ID NO: 5576 - protein, 12 aa, synthetic construct
  REGION 1..12: note = brolucizumab light chain CDR3
QNVYLASTNGAN

SEQ ID NO: 5577 - protein, 117 aa, synthetic construct
  REGION 1..117: note = burosumab heavy chain V region
QVQLVQSGAEVKKPGASVKVSCKASGYTFTNHYMHWVRQAPGQGLEWMGIINPISGSTSNAQKFQGRVTMTRDTSTSTVYMELSSLRSEDTAVYYCARDIVDAFDFWGQGTMVTVSS

SEQ ID NO: 5578 - protein, 8 aa, synthetic construct
  REGION 1..8: note = burosumab heavy chain CDR1
GYTFTNHY

SEQ ID NO: 5579 - protein, 8 aa, synthetic construct
  REGION 1..8: note = burosumab heavy chain CDR2
INPISGST

SEQ ID NO: 5580 - protein, 10 aa, synthetic construct
  REGION 1..10: note = burosumab heavy chain CDR3
ARDIVDAFDF

SEQ ID NO: 5581 - protein, 106 aa, synthetic construct
  REGION 1..106: note = burosumab light chain V region
AIQLTQSPSSLSASVGDRVTITCRASQGISSALVWYQQKPGKAPKLLIYDASSLESGVPSRFSGSGSGTDFTLTISSLQPEDFATYYCQQFNDYFTFGPGTKVDIK

SEQ ID NO: 5582 - protein, 6 aa, synthetic construct
  REGION 1..6: note = burosumab light chain CDR1
QGISSA

SEQ ID NO: 5583 - skipped

SEQ ID NO: 5584 - protein, 9 aa, synthetic construct
  REGION 1..9: note = burosumab light chain CDR3
QQFNDYFTF

SEQ ID NO: 5585 - protein, 115 aa, synthetic construct
  REGION 1..115: note = camidanlumab heavy chain V region
QVQLVQSGAEVKKPGSSVKVSCKASGGTFSRYIINWVRQAPGQGLEWMGRIIPILGVENYAQKFQGRVTITADKSTSTAYMELSSLRSEDTAVYYCARKDWFDYWGQGTLVTVSS

SEQ ID NO: 5586 - protein, 8 aa, synthetic construct
  REGION 1..8: note = camidanlumab heavy chain CDR1
GGTFSRYI

SEQ ID NO: 5587 - protein, 8 aa, synthetic construct
  REGION 1..8: note = camidanlumab heavy chain CDR2
IIPILGVE

SEQ ID NO: 5588 - protein, 8 aa, synthetic construct
  REGION 1..8: note = camidanlumab heavy chain CDR3
ARKDWFDY

SEQ ID NO: 5589 - protein, 107 aa, synthetic construct
  REGION 1..107: note = camidanlumab light chain V region
EIVLTQSPGTLSLSPGERATLSCRASQSVSSYLAWYQQKPGQAPRLLIYGASSRATGIPDRFSGSGSGTDFTLTISRLEPEDFAVYYCQQYGSSPLTFGGGTKVEIK

SEQ ID NO: 5590 - protein, 6 aa, synthetic construct
  REGION 1..6: note = camidanlumab light chain CDR1
QSVSSY

SEQ ID NO: 5591 - skipped

SEQ ID NO: 5592 - protein, 9 aa, synthetic construct
  REGION 1..9: note = camidanlumab light chain CDR3
QQYGSSPLT

SEQ ID NO: 5593 - protein, 115 aa, synthetic construct; identical to SEQ ID NO: 5585
  REGION 1..115: note = camidanlumab tesirine heavy chain V region

SEQ ID NO: 5594 - protein, 8 aa, synthetic construct
  REGION 1..8: note = camidanlumab tesirine heavy chain CDR1
GGTFSRYI

SEQ ID NO: 5595 - protein, 8 aa, synthetic construct
  REGION 1..8: note = camidanlumab tesirine heavy chain CDR2
IIPILGVE

SEQ ID NO: 5596 - protein, 8 aa, synthetic construct
  REGION 1..8: note = camidanlumab tesirine heavy chain CDR3
ARKDWFDY

SEQ ID NO: 5597 - protein, 107 aa, synthetic construct; identical to SEQ ID NO: 5589
  REGION 1..107: note = camidanlumab tesirine light chain V region

SEQ ID NO: 5598 - protein, 6 aa, synthetic construct
  REGION 1..6: note = camidanlumab tesirine light chain CDR1
QSVSSY

SEQ ID NO: 5599 - skipped

SEQ ID NO: 5600 - protein, 9 aa, synthetic construct
  REGION 1..9: note = camidanlumab tesirine light chain CDR3
QQYGSSPLT

SEQ ID NO: 5601 - protein, 118 aa, synthetic construct [sequence omitted]

SEQ ID NO: 5602 - protein, 8 aa, synthetic construct
  REGION 1..8: note = canakinumab heavy chain CDR1
GFTFSVYG

SEQ ID NO: 5603 - protein, 8 aa, synthetic construct
  REGION 1..8: note = canakinumab heavy chain CDR2
IWYDGDNQ

SEQ ID NO: 5604 - protein, 11 aa, synthetic construct
  REGION 1..11: note = canakinumab heavy chain CDR3
ARDLRTGPFDY

SEQ ID NO: 5605 - protein, 107 aa, synthetic construct [sequence omitted]

SEQ ID NO: 5606 - protein, 6 aa, synthetic construct
  REGION 1..6: note = canakinumab light chain CDR1
QSIGSS

SEQ ID NO: 5607 - skipped

SEQ ID NO: 5608 - protein, 9 aa, synthetic construct
  REGION 1..9: note = canakinumab light chain CDR3
HQSSSLPFT

SEQ ID NO: 5609 - protein, 128 aa, synthetic construct
  REGION 1..128: note = caplacizumab heavy chain D1 V region
EVQLVESGGGLVQPGGSLRLSCAASGRTFSYNPMGWFRQAPGKGRELVAAISRTGGSTYYPDSVEGRFTISRDNAKRMVYLQMNSLRAEDTAVYYCAAAGVRAEDGRVRTLPSEYTFWGQGTQVTVSS

SEQ ID NO: 5610 - protein, 8 aa, synthetic construct
  REGION 1..8: note = caplacizumab heavy chain D1 CDR1
GRTFSYNP

SEQ ID NO: 5611 - protein, 8 aa, synthetic construct
  REGION 1..8: note = caplacizumab heavy chain D1 CDR2
ISRTGGST

SEQ ID NO: 5612 - protein, 21 aa, synthetic construct
  REGION 1..21: note = caplacizumab heavy chain D1 CDR3
AAAGVRAEDGRVRTLPSEYTF

SEQ ID NO: 5613 - protein, 128 aa, synthetic construct; identical to SEQ ID NO: 5609
  REGION 1..128: note = caplacizumab heavy chain D3 V region

SEQ ID NO: 5614 - protein, 7 aa, synthetic construct
  REGION 1..7: note = caplacizumab heavy chain D3 CDR1
GRTFSYN

SEQ ID NO: 5615 - protein, 8 aa, synthetic construct
  REGION 1..8: note = caplacizumab heavy chain D3 CDR2
ISRTGGST

SEQ ID NO: 5616 - protein, 21 aa, synthetic construct
  REGION 1..21: note = caplacizumab heavy chain D3 CDR3
AAAGVRAEDGRVRTLPSEYTF

SEQ ID NO: 5617 - protein, 119 aa, synthetic construct
  REGION 1..119: note = carlumab heavy chain V region
QVQLVQSGAEVKKPGSSVKVSCKASGGTFSSYGISWVRQAPGQGLEWMGGIIPIFGTANYAQKFQGRVTITADESTSTAYMELSSLRSEDTAVYYCARYDGIYGELDFWGQGTLVTVSS

SEQ ID NO: 5618 - protein, 7 aa, synthetic construct
  REGION 1..7: note = carlumab heavy chain CDR1
GTFSSYG

SEQ ID NO: 5619 - protein, 8 aa, synthetic construct
  REGION 1..8: note = carlumab heavy chain CDR2
IIPIFGTA

SEQ ID NO: 5620 - protein, 12 aa, synthetic construct
  REGION 1..12: note = carlumab heavy chain CDR3
ARYDGIYGELDF

SEQ ID NO: 5621 - protein, 109 aa, synthetic construct
  REGION 1..109: note = carlumab light chain V region
EIVLTQSPATLSLSPGERATLSCRASQSVSDAYLAWYQQKPGQAPRLLIYDASSRATGVPARFSGSGSGTDFTLTISSLEPEDFAVYYCHQYIQLHSFTFGQGTKVEIK

SEQ ID NO: 5622 - protein, 7 aa, synthetic construct
  REGION 1..7: note = carlumab light chain CDR1
QSVSDAY

SEQ ID NO: 5623 - skipped

SEQ ID NO: 5624 - protein, 10 aa, synthetic construct
  REGION 1..10: note = carlumab light chain CDR3
HQYIQLHSFT

SEQ ID NO: 5625 - protein, 120 aa, synthetic construct; identical to SEQ ID NO: 428
  REGION 1..120: note = casirivimab heavy chain V region

SEQ ID NO: 5626 - protein, 8 aa, synthetic construct
  REGION 1..8: note = casirivimab heavy chain CDR1
GFTFSDYY

SEQ ID NO: 5627 - protein, 8 aa, synthetic construct
  REGION 1..8: note = casirivimab heavy chain CDR2
ITYSGSTI

SEQ ID NO: 5628 - protein, 13 aa, synthetic construct
  REGION 1..13: note = casirivimab heavy chain CDR3
ARDRGTTMVPFDY

SEQ ID NO: 5629 - protein, 107 aa, synthetic construct; identical to SEQ ID NO: 427
  REGION 1..107: note = casirivimab light chain V region

SEQ ID NO: 5630 - protein, 6 aa, synthetic construct
  REGION 1..6: note = casirivimab light chain CDR1
QDITNY

SEQ ID NO: 5631 - skipped

SEQ ID NO: 5632 - protein, 9 aa, synthetic construct
  REGION 1..9: note = casirivimab light chain CDR3
QQYDNLPLT

SEQ ID NO: 5633 - protein, 117 aa, synthetic construct [sequence omitted]

SEQ ID NO: 5634 - protein, 8 aa, synthetic construct
  REGION 1..8: note = cemiplimab heavy chain CDR1
GFTFSNFG

SEQ ID NO: 5635 - protein, 8 aa, synthetic construct
  REGION 1..8: note = cemiplimab heavy chain CDR2
ISGGGRDT

SEQ ID NO: 5636 - protein, 10 aa, synthetic construct
  REGION 1..10: note = cemiplimab heavy chain CDR3
VKWGNIYFDY

SEQ ID NO: 5637 - protein, 107 aa, synthetic construct [sequence omitted]

SEQ ID NO: 5638 - protein, 6 aa, synthetic construct
  REGION 1..6: note = cemiplimab light chain CDR1
LSINTF

SEQ ID NO: 5639 - skipped

SEQ ID NO: 5640 - protein, 9 aa, synthetic construct
  REGION 1..9: note = cemiplimab light chain CDR3
QQSSNTPFT

SEQ ID NO: 5641 - protein, 121 aa, synthetic construct
  REGION 1..121: note = cergutuzumab heavy chain V region
QVQLVQSGAEVKKPGASVKVSCKASGYTFTEFGMNWVRQAPGQGLEWMGWINTKTGEATYVEEFKGRVTFTTDTSTSTAYMELRSLRSDDTAVYYCARWDFAYYVEAMDYWGQGTTVTVSS

SEQ ID NO: 5642 - protein, 8 aa, synthetic construct
  REGION 1..8: note = cergutuzumab heavy chain CDR1
GYTFTEFG

SEQ ID NO: 5643 - protein, 8 aa, synthetic construct
  REGION 1..8: note = cergutuzumab heavy chain CDR2
INTKTGEA

SEQ ID NO: 5644 - protein, 14 aa, synthetic construct
  REGION 1..14: note = cergutuzumab heavy chain CDR3
ARWDFAYYVEAMDY

SEQ ID NO: 5645 - protein, 108 aa, synthetic construct
  REGION 1..108: note = cergutuzumab light chain V region
DIQMTQSPSSLSASVGDRVTITCKASAAVGTYVAWYQQKPGKAPKLLIYSASYRKRGVPSRFSGSGSGTDFTLTISSLQPEDFATYYCHQYYTYPLFTFGQGTKLEIK

SEQ ID NO: 5646 - protein, 6 aa, synthetic construct
  REGION 1..6: note = cergutuzumab light chain CDR1
AAVGTY

SEQ ID NO: 5647 - skipped

SEQ ID NO: 5648 - protein, 11 aa, synthetic construct
  REGION 1..11: note = cergutuzumab light chain CDR3
HQYYTYPLFTF

SEQ ID NO: 5649 - protein, 119 aa, synthetic construct
  REGION 1..119: note = certuximab heavy chain V region
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 5650 - protein, 8 aa, synthetic construct
  REGION 1..8: note = certuximab heavy chain CDR1
GFSLTNYG

SEQ ID NO: 5651 - protein, 7 aa, synthetic construct
  REGION 1..7: note = certuximab heavy chain CDR2
IWSGGNT

SEQ ID NO: 5652 - protein, 13 aa, synthetic construct
  REGION 1..13: note = certuximab heavy chain CDR3
ARALTYYDYEFAY

SEQ ID NO: 5653 - protein, 107 aa, synthetic construct
  REGION 1..107: note = certuximab light chain V region
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 5654 - protein, 6 aa, synthetic construct
  REGION 1..6: note = certuximab light chain CDR1
QSIGTN

SEQ ID NO: 5655 - skipped

SEQ ID NO: 5656 - protein, 9 aa, synthetic construct
  REGION 1..9: note = certuximab light chain CDR3
QQNNNWPTT

SEQ ID NO: 5657 - protein, 123 aa, synthetic construct
  REGION 1..123: note = cetrelimab heavy chain V region
QVQLVQSGAEVKKPGSSVKVSCKASGGTFSSYAISWVRQAPGQGLEWMGGIIPIFDTANYAQKFQGRVTITADESTSTAYMELSSLRSEDTAVYYCARPGLAAAYDTGSLDYWGQGTLVTVSS

SEQ ID NO: 5658 - protein, 8 aa, synthetic construct
  REGION 1..8: note = cetrelimab heavy chain CDR1
GGTFSSYA

SEQ ID NO: 5659 - protein, 8 aa, synthetic construct
  REGION 1..8: note = cetrelimab heavy chain CDR2
IIPIFDTA

SEQ ID NO: 5660 - protein, 16 aa, synthetic construct
  REGION 1..16: note = cetrelimab heavy chain CDR3
ARPGLAAAYDTGSLDY

SEQ ID NO: 5661 - protein, 107 aa, synthetic construct
  REGION 1..107: note = cetrelimab light chain V region
EIVLTQSPATLSLSPGERATLSCRASQSVRSYLAWYQQKPGQAPRLLIYDASNRATGIPARFSGSGSGTDFTLTISSLEPEDFAVYYCQQRNYWPLTFGQGTKVEIK

SEQ ID NO: 5662 - protein, 6 aa, synthetic construct
  REGION 1..6: note = cetrelimab light chain CDR1
QSVRSY

SEQ ID NO: 5663 - skipped

SEQ ID NO: 5664 - protein, 9 aa, synthetic construct
  REGION 1..9: note = cetrelimab light chain CDR3
QQRNYWPLT

SEQ ID NO: 5665 - protein, 131 aa, synthetic construct; identical to SEQ ID NO: 448
  REGION 1..131: note = cilgavimab heavy chain V region

SEQ ID NO: 5666 - protein, 8 aa, synthetic construct
  REGION 1..8: note = cilgavimab heavy chain CDR1
GFTFRDVW

SEQ ID NO: 5667 - protein, 10 aa, synthetic construct
  REGION 1..10: note = cilgavimab heavy chain CDR2
IKSKIDGGTT

SEQ ID NO: 5668 - protein, 22 aa, synthetic construct
  REGION 1..22: note = cilgavimab heavy chain CDR3
TTAGSYYYDTVGPGLPEGKFDY

SEQ ID NO: 5669 - protein, 112 aa, synthetic construct; identical to SEQ ID NO: 447
  REGION 1..112: note = cilgavimab light chain V region

SEQ ID NO: 5670 - protein, 12 aa, synthetic construct
  REGION 1..12: note = cilgavimab light chain CDR1
QSVLYSSNNKNY

SEQ ID NO: 5671 - skipped

SEQ ID NO: 5672 - protein, 8 aa, synthetic construct
  REGION 1..8: note = cilgavimab light chain CDR3
QQYYSTLT

SEQ ID NO: 5673 - protein, 130 aa, synthetic construct
  REGION 1..130: note = cixutumumab heavy chain V region
EVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARAPLRFLEWSTQDHYYYYYMDVWGKGTTVTVSS

SEQ ID NO: 5674 - protein, 8 aa, synthetic construct
  REGION 1..8: note = cixutumumab heavy chain CDR1
GGTFSSYA

SEQ ID NO: 5675 - protein, 8 aa, synthetic construct
  REGION 1..8: note = cixutumumab heavy chain CDR2
IIPIFGTA

SEQ ID NO: 5676 - protein, 23 aa, synthetic construct
  REGION 1..23: note = cixutumumab heavy chain CDR3
ARAPLRFLEWSTQDHYYYYYMDV

SEQ ID NO: 5677 - protein, 108 aa, synthetic construct
  REGION 1..108: note = cixutumumab light chain V region
SSELTQDPAVSVALGQTVRITCQGDSLRSYYATWYQQKPGQAPILVIYGENKRPSGIPDRFSGSSSGNTASLTITGAQAEDEADYYCKSRDGSGQHLVFGGGTKLTVL

SEQ ID NO: 5678 - protein, 6 aa, synthetic construct
  REGION 1..6: note = cixutumumab light chain CDR1
SLRSYY

SEQ ID NO: 5679 - skipped

SEQ ID NO: 5680 - protein, 11 aa, synthetic construct
  REGION 1..11: note = cixutumumab light chain CDR3
KSRDGSGQHLV

SEQ ID NO: 5681 - protein, 122 aa, synthetic construct
  REGION 1..122: note = conatumumab heavy chain V region
QVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYYYGMDVWGQGTTVTVSS

SEQ ID NO: 5682 - protein, 10 aa, synthetic construct
  REGION 1..10: note = conatumumab heavy chain CDR1
GGSISSGDYF

SEQ ID NO: 5683 - protein, 7 aa, synthetic construct
  REGION 1..7: note = conatumumab heavy chain CDR2
IHNSGTT

SEQ ID NO: 5684 - protein, 14 aa, synthetic construct
  REGION 1..14: note = conatumumab heavy chain CDR3
ARDRGGDYYYGMDV

SEQ ID NO: 5685 - protein, 108 aa, synthetic construct
  REGION 1..108: note = conatumumab light chain V region
EIVLTQSPGTLSLSPGERATLSCRASQGISRSYLAWYQQKPGQAPSLLIYGASSRATGIPDRFSGSGSGTDFTLTISRLEPEDFAVYYCQQFGSSPWTFGQGTKVEIK

SEQ ID NO: 5686 - protein, 7 aa, synthetic construct
  REGION 1..7: note = conatumumab light chain CDR1
QGISRSY

SEQ ID NO: 5687 - skipped

SEQ ID NO: 5688 - protein, 8 aa, synthetic construct
  REGION 1..8: note = conatumumab light chain CDR3
QQFGSSPW

SEQ ID NO: 5689 - protein, 120 aa, synthetic construct
  REGION 1..120: note = cosibelimab heavy chain V region
EVQLVQSGAEVKKPGSSVKVSCKASGGTFSRSAISWVRQAPGQGLEWMGVIIPAFGEANYAQKFQGRVTITADESTSTAYMELSSLRSEDTAVYYCARGRQMFGAGIDFWGQGTLVTVSS

SEQ ID NO: 5690 - protein, 8 aa, synthetic construct
  REGION 1..8: note = cosibelimab heavy chain CDR1
GGTFSRSA

SEQ ID NO: 5691 - protein, 8 aa, synthetic construct
  REGION 1..8: note = cosibelimab heavy chain CDR2
IIPAFGEA

SEQ ID NO: 5692 - protein, 13 aa, synthetic construct
  REGION 1..13: note = cosibelimab heavy chain CDR3
ARGRQMFGAGIDF

SEQ ID NO: 5693 - protein, 112 aa, synthetic construct
  REGION 1..112: note = cosibelimab light chain V region
NFMLTQPHSVSESPGKTVTISCTRSSGSIDSNYVQWYQQRPGSAPTTVIYEDNQRPSGVPDRFSGSIDSSSNSASLTISGLKTEDEADYYCQSYDSNNRHVIFGGGTKLTVL

SEQ ID NO: 5694 - protein, 8 aa, synthetic construct
  REGION 1..8: note = cosibelimab light chain CDR1
SGSIDSNY

SEQ ID NO: 5695 - skipped

SEQ ID NO: 5696 - protein, 11 aa, synthetic construct
  REGION 1..11: note = cosibelimab light chain CDR3
QSYDSNNRHVI

SEQ ID NO: 5697 - protein, 122 aa, synthetic construct
  REGION 1..122: note = crizanlizumab heavy chain V region
QVQLVQSGAEVKKPGASVKVSCKVSGYTFTSYDINWVRQAPGKGLEWMGWIYPGDGSIKYNEKFKGRVTMTVDKSTDTAYMELSSLRSEDTAVYYCARRGEYGNYEGAMDYWGQGTLVTVSS

SEQ ID NO: 5698 - protein, 8 aa, synthetic construct
  REGION 1..8: note = crizanlizumab heavy chain CDR1
GYTFTSYD

SEQ ID NO: 5699 - protein, 8 aa, synthetic construct
  REGION 1..8: note = crizanlizumab heavy chain CDR2
IYPGDGSI

SEQ ID NO: 5700 - protein, 15 aa, synthetic construct
  REGION 1..15: note = crizanlizumab heavy chain CDR3
ARRGEYGNYEGAMDY

SEQ ID NO: 5701 - protein, 111 aa, synthetic construct
  REGION 1..111: note = crizanlizumab light chain V region
DIQMTQSPSSLSASVGDRVTITCKASQSVDYDGHSYMNWYQQKPGKAPKLLIYAASNLESGVPSRFSGSGSGTDFTLTISSLQPEDFATYYCQQSDENPLTFGGGTKVEIK

SEQ ID NO: 5702 - protein, 10 aa, synthetic construct
  REGION 1..10: note = crizanlizumab light chain CDR1
QSVDYDGHSY

SEQ ID NO: 5703 - skipped

SEQ ID NO: 5704 - protein, 9 aa, synthetic construct
  REGION 1..9: note = crizanlizumab light chain CDR3
QQSDENPLT

SEQ ID NO: 5705 - protein, 128 aa, synthetic construct
  REGION 1..128: note = crotedumab heavy chain V region
EVQLVESGGGLVQPGGSLRLSCAASGFTFSNYLMNWVRQAPGKGLEWLANIQEDGIEKYYVDSVKGRFTISRDNAKNSLYLQMNSLRAEDTAVYYCAREPSHYDILTGYDYYYGMDVWGQGTTVTVSS

SEQ ID NO: 5706 - protein, 8 aa, synthetic construct
  REGION 1..8: note = crotedumab heavy chain CDR1
GFTFSNYL

SEQ ID NO: 5707 - protein, 8 aa, synthetic construct
  REGION 1..8: note = crotedumab heavy chain CDR2
IQEDGIEK

SEQ ID NO: 5708 - protein, 21 aa, synthetic construct
  REGION 1..21: note = crotedumab heavy chain CDR3
AREPSHYDILTGYDYYYGMDV

SEQ ID NO: 5709 - protein, 107 aa, synthetic construct
  REGION 1..107: note = crotedumab light chain V region
DIQMTQSPSSLSASVGDRVTITCRASQGIRNDLGWYQQKPGKAPKRLIYAASSLQSGVPSRFSGSGSGTEFILTVSSLQPEDFATYYCLQYNSNPFTFGPGTKVDIK

SEQ ID NO: 5710 - protein, 6 aa, synthetic construct
  REGION 1..6: note = crotedumab light chain CDR1
QGIRND

SEQ ID NO: 5711 - skipped

SEQ ID NO: 5712 - protein, 10 aa, synthetic construct
  REGION 1..10: note = crotedumab light chain CDR3
LQYNSNPFTF

SEQ ID NO: 5713 - protein, 124 aa, synthetic construct
  REGION 1..124: note = cudarolimab heavy chain V region
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARGRPWYSETGTSAFDIWGQGTMVTVSS

SEQ ID NO: 5714 - protein, 8 aa, synthetic construct
  REGION 1..8: note = cudarolimab heavy chain CDR1
GFTFSSYG

SEQ ID NO: 5715 - protein, 8 aa, synthetic construct
  REGION 1..8: note = cudarolimab heavy chain CDR2
ISYDGSNK

SEQ ID NO: 5716 - protein, 17 aa, synthetic construct
  REGION 1..17: note = cudarolimab heavy chain CDR3
ARGRPWYSETGTSAFDI

SEQ ID NO: 5717 - protein, 106 aa, synthetic construct
  REGION 1..106: note = cudarolimab light chain V region
DIQMTQSPSSLSASVGDRVTITCQASQDISNYLNWYQQKPGKAPKLLIYDASNLETGVPSRFSGSGSGTDFTFTISSLQPEDIATYYCQQSDHYPTFGGGTKVEIK

SEQ ID NO: 5718 - protein, 6 aa, synthetic construct
  REGION 1..6: note = cudarolimab light chain CDR1
QDISNY

SEQ ID NO: 5719 - skipped

SEQ ID NO: 5720 - protein, 8 aa, synthetic construct
  REGION 1..8: note = cudarolimab light chain CDR3
QQSDHYPT

SEQ ID NO: 5721 - protein, 116 aa, synthetic construct
  REGION 1..116: note = daclizumab heavy chain V region
QVQLVQSGAEVKKPGSSVKVSCKASGYTFTSYRMHWVRQAPGQGLEWIGYINPSTGYTEYNQKFKDKATITADESTNTAYMELSSLRSEDTAVYYCARGGGVFDYWGQGTLVTVSS

SEQ ID NO: 5722 - protein, 8 aa, synthetic construct
  REGION 1..8: note = daclizumab heavy chain CDR1
GYTFTSYR

SEQ ID NO: 5723 - protein, 8 aa, synthetic construct
  REGION 1..8: note = daclizumab heavy chain CDR2
INPSTGYT

SEQ ID NO: 5724 - protein, 9 aa, synthetic construct
  REGION 1..9: note = daclizumab heavy chain CDR3
ARGGGVFDY

SEQ ID NO: 5725 - protein, 106 aa, synthetic construct
  REGION 1..106: note = daclizumab light chain V region
DIQMTQSPSTLSASVGDRVTITCSASSSISYMHWYQQKPGKAPKLLIYTTSNLASGVPARFSGSGSGTEFTLTISSLQPDDFATYYCHQRSTYPLTFGQGTKVEVK

SEQ ID NO: 5726 - protein, 4 aa, synthetic construct
  REGION 1..4: note = daclizumab light chain CDR1
SSIS

SEQ ID NO: 5727 - skipped

SEQ ID NO: 5728 - protein, 9 aa, synthetic construct
  REGION 1..9: note = daclizumab light chain CDR3
HQRSTYPLT

SEQ ID NO: 5729 - protein, 130 aa, synthetic construct
  REGION 1..130: note = dalutrafusp alfa heavy chain V region
QVQLVQSGAEVKKPGSSVKVSCKASGGIFRTYAISWVRQAPGQGLEWMGGIIPMFGTVNYAQKFQGRVTISADKSTSTAYMELSRLRSEDTAVYYCARPPSGGCGGDCSRRGYYYAMDVWGQGTTITVSS

SEQ ID NO: 5730 - protein, 8 aa, synthetic construct
  REGION 1..8: note = dalutrafusp alfa heavy chain CDR1
GGIFRTYA

SEQ ID NO: 5731 - protein, 8 aa, synthetic construct
  REGION 1..8: note = dalutrafusp alfa heavy chain CDR2
IIPMFGTV

SEQ ID NO: 5732 - protein, 23 aa, synthetic construct
  REGION 1..23: note = dalutrafusp alfa heavy chain CDR3
ARPPSGGCGGDCSRRGYYYAMDV

SEQ ID NO: 5733 - protein, 110 aa, synthetic construct
  REGION 1..110: note = dalutrafusp alfa light chain V region
QSALTQPASVSGSPGQSITISCSGSSSDVGGYKYVSWYQQHPGKAPQLMIYDVNNRPSGVSNRFSGSKSGNTASLTISGLQAEDEADYYCSSYTSSSTRVFGGGTKLTVL

SEQ ID NO: 5734 - protein, 9 aa, synthetic construct
  REGION 1..9: note = dalutrafusp alfa light chain CDR1
SSDVGGYKY

SEQ ID NO: 5735 - skipped

SEQ ID NO: 5736 - protein, 10 aa, synthetic construct
  REGION 1..10: note = dalutrafusp alfa light chain CDR3
SSYTSSSTRV

SEQ ID NO: 5737 - protein, 122 aa, synthetic construct [sequence omitted]

SEQ ID NO: 5738 - protein, 8 aa, synthetic construct
  REGION 1..8: note = daratumumab heavy chain CDR1
GFTFNSFA

SEQ ID NO: 5739 - protein, 8 aa, synthetic construct
  REGION 1..8: note = daratumumab heavy chain CDR2
ISGSGGGT

SEQ ID NO: 5740 - protein, 15 aa, synthetic construct
  REGION 1..15: note = daratumumab heavy chain CDR3
AKDKILWFGEPVFDY

SEQ ID NO: 5741 - protein, 107 aa, synthetic construct [sequence omitted]

SEQ ID NO: 5742 - protein, 6 aa, synthetic construct
  REGION 1..6: note = daratumumab light chain CDR1
QSVSSY

SEQ ID NO: 5743 - skipped

SEQ ID NO: 5744 - protein, 10 aa, synthetic construct
  REGION 1..10: note = daratumumab light chain CDR3
QQRSNWPPTF

SEQ ID NO: 5745 - protein, 122 aa, synthetic construct
  REGION 1..122: note = daxdilimab heavy chain V region
QVQLQQSGAEVKKPGASVKVSCKASGYTFTSYGISWVRQAPGQGLEWMGWISAYNGNTNYAQKLQGRVTMTTDTSTSTAYMELRSLRSDDTAVYYCARNGLWGWDSDAFDIWGRGTLVTVSS

SEQ ID NO: 5746 - protein, 8 aa, synthetic construct
  REGION 1..8: note = daxdilimab heavy chain CDR1
GYTFTSYG

SEQ ID NO: 5747 - protein, 8 aa, synthetic construct
  REGION 1..8: note = daxdilimab heavy chain CDR2
ISAYNGNT

SEQ ID NO: 5748 - protein, 15 aa, synthetic construct
  REGION 1..15: note = daxdilimab heavy chain CDR3
ARNGLWGWDSDAFDI

SEQ ID NO: 5749 - protein, 110 aa, synthetic construct
  REGION 1..110: note = daxdilimab light chain V region
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTVVFGGGTKVTVL

SEQ ID NO: 5750 - protein, 9 aa, synthetic construct
  REGION 1..9: note = daxdilimab light chain CDR1
SSDVGGYNY

SEQ ID NO: 5751 - skipped

SEQ ID NO: 5752 - protein, 10 aa, synthetic construct
  REGION 1..10: note = daxdilimab light chain CDR3
SSYTSSSTVV

SEQ ID NO: 5753 - protein, 120 aa, synthetic construct
  REGION 1..120: note = dectrekumab heavy chain V region
EVQLVESGGGVVQPGRSLRLSCAASGFTFSSYGMHWVRQAPGKGLEWVAIIWYDGSNKYYADSVKGRFTISRDNSKNTLYLQMNSLRAEDTAVYYCARLWFGDLDAFDIWGQGTMVTVSS

SEQ ID NO: 5754 - protein, 8 aa, synthetic construct
  REGION 1..8: note = dectrekumab heavy chain CDR1
GFTFSSYG

SEQ ID NO: 5755 - protein, 8 aa, synthetic construct
  REGION 1..8: note = dectrekumab heavy chain CDR2
IWYDGSNK

SEQ ID NO: 5756 - protein, 13 aa, synthetic construct
  REGION 1..13: note = dectrekumab heavy chain CDR3
ARLWFGDLDAFDI

SEQ ID NO: 5757 - protein, 109 aa, synthetic construct
  REGION 1..109: note = dectrekumab light chain V region
EIVLTQSPATLSLSPGERAILSCRAGQSVSSYLVWYQQKPGQAPRLLIYDASNRATGIPARFSGSGSGTDFTLTISSLEPEDFAVYYCQQRSSWPPVYTFGQGTKLEIK

SEQ ID NO: 5758 - protein, 6 aa, synthetic construct
  REGION 1..6: note = dectrekumab light chain CDR1
QSVSSY

SEQ ID NO: 5759 - skipped

SEQ ID NO: 5760 - protein, 11 aa, synthetic construct
  REGION 1..11: note = dectrekumab light chain CDR3
QQRSSWPPVYT

SEQ ID NO: 5761 - protein, 119 aa, synthetic construct [sequence omitted]

SEQ ID NO: 5762 - protein, 10 aa, synthetic construct
  REGION 1..10: note = demupitamab heavy chain CDR1
GGSVSSGDYY

SEQ ID NO: 5763 - protein, 7 aa, synthetic construct
  REGION 1..7: note = demupitamab heavy chain CDR2
IYYSGNT

SEQ ID NO: 5764 - protein, 11 aa, synthetic construct
  REGION 1..11: note = demupitamab heavy chain CDR3
VRDRVTGAFDI

SEQ ID NO: 5765 - protein, 107 aa, synthetic construct
  REGION 1..107: note = demupitamab light chain V region
DIQMTQSPSTLSASVGDRVTITCQASQDISNYLNWYQQKPGKAPKLLIYDASNLETGVPSRFSGSGSGTDFTFTISSLQPEDIATYFCQHFDHLPLAFGGGTKVEIK

SEQ ID NO: 5766 - protein, 6 aa, synthetic construct
  REGION 1..6: note = demupitamab light chain CDR1
QDISNY

SEQ ID NO: 5767 - skipped

SEQ ID NO: 5768 - protein, 9 aa, synthetic construct
  REGION 1..9: note = demupitamab light chain CDR3
QHFDHLPLA

SEQ ID NO: 5769 - protein, 122 aa, synthetic construct
  REGION 1..122: note = denosumab heavy chain V region
EVQLLESGGGLVQPGGSLRLSCAASGFTFSSYAMSWVRQAPGKGLEWVSGITGSGGSTYYADSVKGRFTISRDNSKNTLYLQMNSLRAEDTAVYYCAKDPGTTVIMSWFDPWGQGTLVTVSS

SEQ ID NO: 5770 - protein, 8 aa, synthetic construct
  REGION 1..8: note = denosumab heavy chain CDR1
GFTFSSYA

SEQ ID NO: 5771 - protein, 8 aa, synthetic construct
  REGION 1..8: note = denosumab heavy chain CDR2
ITGSGGST

SEQ ID NO: 5772 - protein, 15 aa, synthetic construct
  REGION 1..15: note = denosumab heavy chain CDR3
AKDPGTTVIMSWFDP

SEQ ID NO: 5773 - protein, 108 aa, synthetic construct
  REGION 1..108: note = denosumab light chain V region
EIVLTQSPGTLSLSPGERATLSCRASQSVRGRYLAWYQQKPGQAPRLLIYGASSRATGIPDRFSGSGSGTDFTLTISRLEPEDFAVFYCQQYGSSPRTFGQGTKVEIK

SEQ ID NO: 5774 - protein, 7 aa, synthetic construct
  REGION 1..7: note = denosumab light chain CDR1
QSVRGRY

SEQ ID NO: 5775 - skipped

SEQ ID NO: 5776 - protein, 9 aa, synthetic construct
  REGION 1..9: note = denosumab light chain CDR3
QQYGSSPRT

SEQ ID NO: 5777 - protein, 113 aa, synthetic construct [sequence omitted]

SEQ ID NO: 5778 - protein, 8 aa, synthetic construct
  REGION 1..8: note = dinutuximab heavy chain CDR1
GSSFTGYN

SEQ ID NO: 5779 - protein, 8 aa, synthetic construct
  REGION 1..8: note = dinutuximab heavy chain CDR2
IDPYYGGT

SEQ ID NO: 5780 - protein, 6 aa, synthetic construct
  REGION 1..6: note = dinutuximab heavy chain CDR3
VSGMEY

SEQ ID NO: 5781 - protein, 113 aa, synthetic construct [sequence omitted]

SEQ ID NO: 5782 - protein, 11 aa, synthetic construct
  REGION 1..11: note = dinutuximab light chain CDR1
QSLVHRNGNTY

SEQ ID NO: 5783 - skipped

SEQ ID NO: 5784 - protein, 10 aa, synthetic construct
  REGION 1..10: note = dinutuximab light chain CDR3
SQSTHVPPLT

SEQ ID NO: 5785 - protein, 121 aa, synthetic construct [sequence omitted]

SEQ ID NO: 5786 - protein, 8 aa, synthetic construct
  REGION 1..8: note = diridavumab heavy chain CDR1
GGPFRSYA

SEQ ID NO: 5787 - protein, 8 aa, synthetic construct
  REGION 1..8: note = diridavumab heavy chain CDR2
IIPIFGTT

SEQ ID NO: 5788 - protein, 14 aa, synthetic construct
  REGION 1..14: note = diridavumab heavy chain CDR3
AKHMGYQVRETMDV

SEQ ID NO: 5789 - protein, 111 aa, synthetic construct [sequence omitted]

SEQ ID NO: 5790 - protein, 8 aa, synthetic construct
  REGION 1..8: note = diridavumab light chain CDR1
SSNIGNDY

SEQ ID NO: 5791 - skipped

SEQ ID NO: 5792 - protein, 12 aa, synthetic construct
  REGION 1..12: note = diridavumab light chain CDR3
ATWDRRPTAYVV

SEQ ID NO: 5793 - protein, 116 aa, synthetic construct
  REGION 1..116: note = dostarlimab heavy chain V region
EVQLLESGGGLVQPGGSLRLSCAASGFTFSSYDMSWVRQAPGKGLEWVSTISGGGSYTYYQDSVKGRFTISRDNSKNTLYLQMNSLRAEDTAVYYCASPYYAMDYWGQGTTVTVSS

SEQ ID NO: 5794 - protein, 8 aa, synthetic construct
  REGION 1..8: note = dostarlimab heavy chain CDR1
GFTFSSYD

SEQ ID NO: 5795 - protein, 8 aa, synthetic construct
  REGION 1..8: note = dostarlimab heavy chain CDR2
ISGGGSYT

SEQ ID NO: 5796 - protein, 9 aa, synthetic construct
  REGION 1..9: note = dostarlimab heavy chain CDR3
ASPYYAMDY

SEQ ID NO: 5797 - protein, 107 aa, synthetic construct
  REGION 1..107: note = dostarlimab light chain V region
DIQLTQSPSFLSAYVGDRVTITCKASQDVGTAVAWYQQKPGKAPKLLIYWASTLHTGVPSRFSGSGSGTEFTLTISSLQPEDFATYYCQHYSSYPWTFGQGTKLEIK

SEQ ID NO: 5798 - protein, 6 aa, synthetic construct
  REGION 1..6: note = dostarlimab light chain CDR1
QDVGTA

SEQ ID NO: 5799 - skipped

SEQ ID NO: 5800 - protein, 9 aa, synthetic construct
  REGION 1..9: note = dostarlimab light chain CDR3
QHYSSYPWT

SEQ ID NO: 5801 - protein, 121 aa, synthetic construct [sequence omitted]

SEQ ID NO: 5802 - protein, 8 aa, synthetic construct
  REGION 1..8: note = drozitumab heavy chain CDR1
GFTFDDYA

SEQ ID NO: 5803 - protein, 8 aa, synthetic construct
  REGION 1..8: note = drozitumab heavy chain CDR2
INWQGGST

SEQ ID NO: 5804 - protein, 14 aa, synthetic construct
  REGION 1..14: note = drozitumab heavy chain CDR3
AKILGAGRGWYFDY

SEQ ID NO: 5805 - protein, 107 aa, synthetic construct [sequence omitted]

SEQ ID NO: 5806 - protein, 6 aa, synthetic construct
  REGION 1..6: note = drozitumab light chain CDR1
SLRSYY

SEQ ID NO: 5807 - skipped

SEQ ID NO: 5808 - protein, 11 aa, synthetic construct
  REGION 1..11: note = drozitumab light chain CDR3
NSADSSGNHVV

SEQ ID NO: 5809 - protein, 125 aa, synthetic construct [sequence omitted]

SEQ ID NO: 5810 - protein, 8 aa, synthetic construct
  REGION 1..8: note = dupilumab heavy chain CDR1
GFTFRDYA

SEQ ID NO: 5811 - protein, 8 aa, synthetic construct
  REGION 1..8: note = dupilumab heavy chain CDR2
ISGSGGNT

SEQ ID NO: 5812 - protein, 18 aa, synthetic construct
  REGION 1..18: note = dupilumab heavy chain CDR3
AKDRLSITIRPRYYGLDV

SEQ ID NO: 5813 - protein, 112 aa, synthetic construct [sequence omitted]

SEQ ID NO: 5814 - protein, 11 aa, synthetic construct
  REGION 1..11: note = dupilumab light chain CDR1
QSLLYSIGYNY

SEQ ID NO: 5815 - skipped

SEQ ID NO: 5816 - protein, 9 aa, synthetic construct
  REGION 1..9: note = dupilumab light chain CDR3
MQALQTPYT

SEQ ID NO: 5817 - protein, 121 aa, synthetic construct
  REGION 1..121: note = durvalumab heavy chain V region
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSS

SEQ ID NO: 5818 - protein, 11 aa, synthetic construct
  REGION 1..11: note = durvalumab heavy chain CDR1
GFTFSRYWMSW

SEQ ID NO: 5819 - protein, 8 aa, synthetic construct
  REGION 1..8: note = durvalumab heavy chain CDR2
IKQDGSEK

SEQ ID NO: 5820 - protein, 14 aa, synthetic construct
  REGION 1..14: note = durvalumab heavy chain CDR3
AREGGWFGELAFDY

SEQ ID NO: 5821 - protein, 108 aa, synthetic construct
  REGION 1..108: note = durvalumab light chain V region
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIK

SEQ ID NO: 5822 - protein, 7 aa, synthetic construct
  REGION 1..7: note = durvalumab light chain CDR1
QRVSSSY

SEQ ID NO: 5823 - skipped

SEQ ID NO: 5824 - protein, 9 aa, synthetic construct
  REGION 1..9: note = durvalumab light chain CDR3
QQYGSLPWT

SEQ ID NO: 5825 - protein, 120 aa, synthetic construct
  REGION 1..120: note = dusigitumab heavy chain V region
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARDPYYYYYGMDVWGQGTTVTVSS

SEQ ID NO: 5826 - protein, 8 aa, synthetic construct
  REGION 1..8: note = dusigitumab heavy chain CDR1
GYTFTSYD

SEQ ID NO: 5827 - protein, 8 aa, synthetic construct
  REGION 1..8: note = dusigitumab heavy chain CDR2
MNPNSGNT

SEQ ID NO: 5828 - protein, 12 aa, synthetic construct
  REGION 1..12: note = dusigitumab heavy chain CDR3
ARDPYYYYYGMD

SEQ ID NO: 5829 - protein, 111 aa, synthetic construct
  REGION 1..111: note = dusigitumab light chain V region
QSVLTQPPSVSAAPGQKVTISCSGSSSNIENNHVSWYQQLPGTAPKLLIYDNNKRPSGIPDRFSGSKSGTSATLGITGLQTGDEADYYCETWDTSLSAGRVFGGGTKLTVL

SEQ ID NO: 5830 - protein, 8 aa, synthetic construct
  REGION 1..8: note = dusigitumab light chain CDR1
SSNIENNH

SEQ ID NO: 5831 - skipped

SEQ ID NO: 5832 - protein, 12 aa, synthetic construct
  REGION 1..12: note = dusigitumab light chain CDR3
ETWDTSLSAGRV

SEQ ID NO: 5833 - protein, 118 aa, synthetic construct
  REGION 1..118: note = eblasakimab heavy chain V region
EVQLVQSGAEVKKPGESLKISCKGSGYSFTSYWIGWVRQMPGKGLEWMGVIYPGDSYTRYSPSFQGQVTISADKSISTAYLQWSSLKASDTAMYYCARMPNWGSLDHWGQGTLVTVSS

SEQ ID NO: 5834 - protein, 8 aa, synthetic construct
  REGION 1..8: note = eblasakimab heavy chain CDR1
GYSFTSYW

SEQ ID NO: 5835 - protein, 8 aa, synthetic construct
  REGION 1..8: note = eblasakimab heavy chain CDR2
IYPGDSYT

SEQ ID NO: 5836 - protein, 11 aa, synthetic construct
  REGION 1..11: note = eblasakimab heavy chain CDR3
ARMPNWGSLDH

SEQ ID NO: 5837 - protein, 104 aa, synthetic construct
  REGION 1..104: note = eblasakimab light chain V region
EIVLTQSPGTLSLSPGERATLSCRASQSISSSYLAWYQQKPGQAPRLLIYGASSRATGIPDRFSGSGSGTDFTLTISRLEPEDFAVYYCQQYASFGQGTKVEIK

SEQ ID NO: 5838 - protein, 7 aa, synthetic construct
  REGION 1..7: note = eblasakimab light chain CDR1
QSISSSY

SEQ ID NO: 5839 - skipped

SEQ ID NO: 5840 - protein, 5 aa, synthetic construct
  REGION 1..5: note = eblasakimab light chain CDR3
QQYAS

SEQ ID NO: 5841 - protein, 123 aa, synthetic construct
  REGION 1..123: note = ebronucimab heavy chain V region
EVQLVESGGGLVQPGRSLRLSCAASGFTFSSYSMNWVRQAPGKGLEWVSGISSSSSYISYADSVQGRFTISRDNGKNSLYLQMNSLRAEDTALYFCAREYDFWSAYYDAFDVWGQGTMVTVSS

SEQ ID NO: 5842 - protein, 8 aa, synthetic construct
  REGION 1..8: note = ebronucimab heavy chain CDR1
GFTFSSYS

SEQ ID NO: 5843 - protein, 9 aa, synthetic construct
  REGION 1..9: note = ebronucimab heavy chain CDR2
ISSSSSYIS

SEQ ID NO: 5844 - protein, 16 aa, synthetic construct
  REGION 1..16: note = ebronucimab heavy chain CDR3
AREYDFWSAYYDAFDV

SEQ ID NO: 5845 - protein, 111 aa, synthetic construct
  REGION 1..111: note = ebronucimab light chain V region
QSELTQPRSVSGSPGQSVTISCTGTSRNIGGGNDVHWYQQHPGKAPKLLISGVIERSSGVPDRFSGSKSGNTASLTISGLQAEDEADYYCQSFDGSLSGSVFGTGTDVTVL

SEQ ID NO: 5846 - protein, 9 aa, synthetic construct
  REGION 1..9: note = ebronucimab light chain CDR1
SRNIGGGND

SEQ ID NO: 5847 - skipped

SEQ ID NO: 5848 - protein, 11 aa, synthetic construct
  REGION 1..11: note = ebronucimab light chain CDR3
QSFDGSLSGSV

SEQ ID NO: 5849 - protein, 122 aa, synthetic construct [sequence omitted]

SEQ ID NO: 5850 - protein, 8 aa, synthetic construct
  REGION 1..8: note = eculizumab heavy chain CDR1
GYIFSNYW

SEQ ID NO: 5851 - protein, 8 aa, synthetic construct
  REGION 1..8: note = eculizumab heavy chain CDR2
ILPGSGST

SEQ ID NO: 5852 - protein, 15 aa, synthetic construct
  REGION 1..15: note = eculizumab heavy chain CDR3
ARYFFGSSPNWYFDV

SEQ ID NO: 5853 - protein, 107 aa, synthetic construct [sequence omitted]

SEQ ID NO: 5854 - protein, 6 aa, synthetic construct
  REGION 1..6: note = eculizumab light chain CDR1
ENIYGA

SEQ ID NO: 5855 - skipped

SEQ ID NO: 5856 - protein, 9 aa, synthetic construct
  REGION 1..9: note = eculizumab light chain CDR3
QNVLNTPLT

SEQ ID NO: 5857 - protein, 124 aa, synthetic construct
  REGION 1..124: note = eldelumab heavy chain V region
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSS

SEQ ID NO: 5858 - protein, 8 aa, synthetic construct
  REGION 1..8: note = eldelumab heavy chain CDR1
GFTFSNNG

SEQ ID NO: 5859 - protein, 8 aa, synthetic construct
  REGION 1..8: note = eldelumab heavy chain CDR2
IWFDGMNK

SEQ ID NO: 5860 - protein, 17 aa, synthetic construct
  REGION 1..17: note = eldelumab heavy chain CDR3
AREGDGSGIYYYYGMDV

SEQ ID NO: 5861 - protein, 109 aa, synthetic construct
  REGION 1..109: note = eldelumab light chain V region
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPIFTFGPGTKVDIK

SEQ ID NO: 5862 - protein, 7 aa, synthetic construct
  REGION 1..7: note = eldelumab light chain CDR1
QSVSSSY

SEQ ID NO: 5863 - skipped

SEQ ID NO: 5864 - protein, 11 aa, synthetic construct
  REGION 1..11: note = eldelumab light chain CDR3
QQYGSSPIFTF

SEQ ID NO: 5865 - protein, 120 aa, synthetic construct
  REGION 1..120: note = elezanumab heavy chain V region
EVQLVQSGAEVKKPGASVKVSCKASGYTFTSHGISWVRQAPGQGLDWMGWISPYSGNTNYAQKLQGRVTMTTDTSTSTAYMELSSLRSEDTAVYYCARVGSGPYYYMDVWGQGTLVTVSS

SEQ ID NO: 5866 - protein, 8 aa, synthetic construct
  REGION 1..8: note = elezanumab heavy chain CDR1
GYTFTSHG

SEQ ID NO: 5867 - protein, 8 aa, synthetic construct
  REGION 1..8: note = elezanumab heavy chain CDR2
ISPYSGNT

SEQ ID NO: 5868 - protein, 13 aa, synthetic construct
  REGION 1..13: note = elezanumab heavy chain CDR3
ARVGSGPYYYMDV

SEQ ID NO: 5869 - protein, 109 aa, synthetic construct
  REGION 1..109: note = elezanumab light chain V region
QSALTQPRSVSGSPGQSVTISCTGTSSSVGDSIYVSWYQQHPGKAPKLMLYDVTKRPSGVPDRFSGSKSGNTASLTISGLQAEDEADYYCYSYAGTDTLFGGGTKVTVL

SEQ ID NO: 5870 - protein, 8 aa, synthetic construct
  REGION 1..8: note = elezanumab light chain CDR1
SSVGDSIY

SEQ ID NO: 5871 - skipped

SEQ ID NO: 5872 - protein, 9 aa, synthetic construct
  REGION 1..9: note = elezanumab light chain CDR3
YSYAGTDTL

SEQ ID NO: 5873 - protein, 117 aa, synthetic construct
  REGION 1..117: note = elgemtumab heavy chain V region
EVQLLESGGGLVQPGGSLRLSCAASGFTFSSYAMSWVRQAPGKGLEWVSAINSQGKSTYYADSVKGRFTISRDNSKNTLYLQMNSLRAEDTAVYYCARWGDEGFDIWGQGTLVTVSS

SEQ ID NO: 5874 - protein, 8 aa, synthetic construct
  REGION 1..8: note = elgemtumab heavy chain CDR1
GFTFSSYA

SEQ ID NO: 5875 - protein, 8 aa, synthetic construct
  REGION 1..8: note = elgemtumab heavy chain CDR2
INSQGKST

SEQ ID NO: 5876 - protein, 10 aa, synthetic construct
  REGION 1..10: note = elgemtumab heavy chain CDR3
ARWGDEGFDI

SEQ ID NO: 5877 - protein, 107 aa, synthetic construct
  REGION 1..107: note = elgemtumab light chain V region
DIQMTQSPSSLSASVGDRVTITCRASQGISNWLAWYQQKPGKAPKLLIYGASSLQSGVPSRFSGSGSGTDFTLTISSLQPEDFATYYCQQYSSFPTTFGQGTKVEIK

SEQ ID NO: 5878 - protein, 6 aa, synthetic construct
  REGION 1..6: note = elgemtumab light chain CDR1
QGISNW

SEQ ID NO: 5879 - skipped

SEQ ID NO: 5880 - protein, 9 aa, synthetic construct
  REGION 1..9: note = elgemtumab light chain CDR3
QQYSSFPTT

SEQ ID NO: 5881 - protein, 132 aa, synthetic construct
  REGION 1..132: note = elipovimab heavy chain V region
QMQLQESGPGLVKPSETLSLTCSVSGASISDSYWSWIRRSPGKGLEWIGYVHKSGDTNYNPSLKSRVHLSLDTSKNQVSLSLTGVTAADSGKYYCARTLHGRRIYGIVAFNEWFTYFYMDVWGTGTQVTVSS

SEQ ID NO: 5882 - protein, 8 aa, synthetic construct
  REGION 1..8: note = elipovimab heavy chain CDR1
GASISDSY

SEQ ID NO: 5883 - protein, 7 aa, synthetic construct
  REGION 1..7: note = elipovimab heavy chain CDR2
VHKSGDT

SEQ ID NO: 5884 - protein, 26 aa, synthetic construct
  REGION 1..26: note = elipovimab heavy chain CDR3
ARTLHGRRIYGIVAFNEWFTYFYMDV

SEQ ID NO: 5885 - protein, 105 aa, synthetic construct
  REGION 1..105: note = elipovimab light chain V region
SDISVAPGETARISCGEKSLGSRAVQWYQHRAGQAPSLIIYNNQDRPSGIPERFSGSPDSRPGTTATLTITSVEAGDEADYYCHIWDSRVPTKWVFGGGTTLTVL

SEQ ID NO: 5886 - protein, 6 aa, synthetic construct
  REGION 1..6: note = elipovimab light chain CDR1
SLGSRA

SEQ ID NO: 5887 - skipped

SEQ ID NO: 5888 - protein, 13 aa, synthetic construct
  REGION 1..13: note = elipovimab light chain CDR3
CHIWDSRVPTKWV

SEQ ID NO: 5889 - protein, 119 aa, synthetic construct
  REGION 1..119: note = elotuzumab heavy chain V region
EVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSS

SEQ ID NO: 5890 - protein, 8 aa, synthetic construct
  REGION 1..8: note = elotuzumab heavy chain CDR1
GFDFSRYW

SEQ ID NO: 5891 - protein, 8 aa, synthetic construct
  REGION 1..8: note = elotuzumab heavy chain CDR2
INPDSSTI

SEQ ID NO: 5892 - protein, 12 aa, synthetic construct
  REGION 1..12: note = elotuzumab heavy chain CDR3
ARPDGNYWYFDV

SEQ ID NO: 5893 - protein, 107 aa, synthetic construct
  REGION 1..107: note = elotuzumab light chain V region
DIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIK

SEQ ID NO: 5894 - protein, 6 aa, synthetic construct
  REGION 1..6: note = elotuzumab light chain CDR1
QDVGIA

SEQ ID NO: 5895 - skipped

SEQ ID NO: 5896 - protein, 9 aa, synthetic construct
  REGION 1..9: note = elotuzumab light chain CDR3
QQYSSYPYT

SEQ ID NO: 5897 - protein, 115 aa, synthetic construct
  REGION 1..115: note = elranatamab heavy chain V region
EVQLLESGGGLVQPGGSLRLSCAASGFTFSSYPMSWVRQAPGKGLEWVSAIGGSGGSLPYADIVKGRFTISRDNSKNTLYLQMNSLRAEDTAVYYCARYWPMDIWGQGTLVTVSS

SEQ ID NO: 5898 - protein, 8 aa, synthetic construct
  REGION 1..8: note = elranatamab heavy chain CDR1
GFTFSSYP

SEQ ID NO: 5899 - protein, 8 aa, synthetic construct
  REGION 1..8: note = elranatamab heavy chain CDR2
IGGSGGSL

SEQ ID NO: 5900 - protein, 8 aa, synthetic construct
  REGION 1..8: note = elranatamab heavy chain CDR3
ARYWPMDI

SEQ ID NO: 5901 - protein, 108 aa, synthetic construct
  REGION 1..108: note = elranatamab light chain V region
EIVLTQSPGTLSLSPGERATLSCRASQSVSSSYLAWYQQKPGQAPRLLMYDASIRATGIPDRFSGSGSGTDFTLTISRLEPEDFAVYYCQQYQSWPLTFGQGTKVEIK

SEQ ID NO: 5902 - protein, 7 aa, synthetic construct
  REGION 1..7: note = elranatamab light chain CDR1
QSVSSSY

SEQ ID NO: 5903 - skipped

SEQ ID NO: 5904 - protein, 9 aa, synthetic construct
  REGION 1..9: note = elranatamab light chain CDR3
QQYQSWPLT

SEQ ID NO: 5905 - protein, 123 aa, synthetic construct
  REGION 1..123: note = emapalumab heavy chain V region
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDGSSGWYVPHWFDPWGQGTLVTVSS

SEQ ID NO: 5906 - protein, 8 aa, synthetic construct
  REGION 1..8: note = emapalumab heavy chain CDR1
GFTFSSYA

SEQ ID NO: 5907 - protein, 8 aa, synthetic construct
  REGION 1..8: note = emapalumab heavy chain CDR2
ISGSGGST

SEQ ID NO: 5908 - protein, 16 aa, synthetic construct
  REGION 1..16: note = emapalumab heavy chain CDR3
AKDGSSGWYVPHWFDP

SEQ ID NO: 5909 - protein, 111 aa, synthetic construct
  REGION 1..111: note = emapalumab light chain V region
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDGSNRWMFGGGTKLTVL

SEQ ID NO: 5910 - protein, 8 aa, synthetic construct
  REGION 1..8: note = emapalumab light chain CDR1
SGSIASNY

SEQ ID NO: 5911 - skipped

SEQ ID NO: 5912 - protein, 10 aa, synthetic construct
  REGION 1..10: note = emapalumab light chain CDR3
QSYDGSNRWM

SEQ ID NO: 5913 - protein, 116 aa, synthetic construct
  REGION 1..116: note = enapotamab heavy chain V region
EVQLLESGGGLVQPGGSLRLSCAASGFTFSSYAMNWVRQAPGKGLEWVSTTSGSGASTYYADSVKGRFTISRDNSKNTLYLQMNSLRAEDTAVYYCAKIWIAFDIWGQGTMVTVSS

SEQ ID NO: 5914 - protein, 8 aa, synthetic construct
  REGION 1..8: note = enapotamab heavy chain CDR1
GFTFSSYA

SEQ ID NO: 5915 - protein, 8 aa, synthetic construct
  REGION 1..8: note = enapotamab heavy chain CDR2
TSGSGAST

SEQ ID NO: 5916 - protein, 9 aa, synthetic construct
  REGION 1..9: note = enapotamab heavy chain CDR3
AKIWIAFDI

SEQ ID NO: 5917 - protein, 108 aa, synthetic construct
  REGION 1..108: note = enapotamab light chain V region
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPYTFGQGTKLEIK

SEQ ID NO: 5918 - protein, 7 aa, synthetic construct
  REGION 1..7: note = enapotamab light chain CDR1
QSVSSSY

SEQ ID NO: 5919 - skipped

SEQ ID NO: 5920 - protein, 9 aa, synthetic construct
  REGION 1..9: note = enapotamab light chain CDR3
QQYGSSPYT

SEQ ID NO: 5921 - protein, 116 aa, synthetic construct; identical to SEQ ID NO: 5913
  REGION 1..116: note = enapotamab vedotin heavy chain V region

SEQ ID NO: 5922 - protein, 8 aa, synthetic construct
  REGION 1..8: note = enapotamab vedotin heavy chain CDR1
GFTFSSYA

SEQ ID NO: 5923 - protein, 8 aa, synthetic construct
  REGION 1..8: note = enapotamab vedotin heavy chain CDR2
TSGSGAST

SEQ ID NO: 5924 - protein, 9 aa, synthetic construct
  REGION 1..9: note = enapotamab vedotin heavy chain CDR3
AKIWIAFDI

SEQ ID NO: 5925 - protein, 108 aa, synthetic construct; identical to SEQ ID NO: 5917
  REGION 1..108: note = enapotamab vedotin light chain V region

SEQ ID NO: 5926 - protein, 8 aa, synthetic construct
  REGION 1..8: note = enapotamab vedotin light chain CDR1
QSVSSSYL

SEQ ID NO: 5927 - skipped

SEQ ID NO: 5928 - protein, 9 aa, synthetic construct
  REGION 1..9: note = enapotamab vedotin light chain CDR3
QQYGSSPYT

SEQ ID NO: 5929 - protein, 117 aa, synthetic construct
  REGION 1..117: note = enfortumab vedotin heavy chain V region
EVQLVESGGGLVQPGGSLRLSCAASGFTFSSYNMNWVRQAPGKGLEWVSYISSSSSTIYYADSVKGRFTISRDNAKNSLSLQMNSLRDEDTAVYYCARAYYYGMDVWGQGTTVTVSS

SEQ ID NO: 5930 - protein, 8 aa, synthetic construct
  REGION 1..8: note = enfortumab vedotin heavy chain CDR1
GFTFSSYN

SEQ ID NO: 5931 - protein, 8 aa, synthetic construct
  REGION 1..8: note = enfortumab vedotin heavy chain CDR2
ISSSSSTI

SEQ ID NO: 5932 - protein, 10 aa, synthetic construct
  REGION 1..10: note = enfortumab vedotin heavy chain CDR3
ARAYYYGMDV

SEQ ID NO: 5933 - protein, 107 aa, synthetic construct
  REGION 1..107: note = enfortumab vedotin light chain V region
DIQMTQSPSSVSASVGDRVTITCRASQGISGWLAWYQQKPGKAPKFLIYAASTLQSGVPSRFSGSGSGTDFTLTISSLQPEDFATYYCQQANSFPPTFGGGTKVEIK

SEQ ID NO: 5934 - protein, 6 aa, synthetic construct
  REGION 1..6: note = enfortumab vedotin light chain CDR1
QGISGW

SEQ ID NO: 5935 - skipped

SEQ ID NO: 5936 - protein, 9 aa, synthetic construct
  REGION 1..9: note = enfortumab vedotin light chain CDR3
QQANSFPPT

SEQ ID NO: 5937 - protein, 122 aa, synthetic construct
  REGION 1..122: note = enoblituzumab heavy chain V region
EVQLVESGGGLVQPGGSLRLSCAASGFTFSSFGMHWVRQAPGKGLEWVAYISSDSSAIYYADTVKGRFTISRDNAKNSLYLQMNSLRDEDTAVYYCGRGRENIYYGSRLDYWGQGTTVTVSS

SEQ ID NO: 5938 - protein, 8 aa, synthetic construct
  REGION 1..8: note = enoblituzumab heavy chain CDR1
GFTFSSFG

SEQ ID NO: 5939 - protein, 8 aa, synthetic construct
  REGION 1..8: note = enoblituzumab heavy chain CDR2
ISSDSSAI

SEQ ID NO: 5940 - protein, 15 aa, synthetic construct
  REGION 1..15: note = enoblituzumab heavy chain CDR3
GRGRENIYYGSRLDY

SEQ ID NO: 5941 - protein, 107 aa, synthetic construct
  REGION 1..107: note = enoblituzumab light chain V region
DIQLTQSPSFLSASVGDRVTITCKASQNVDTNVAWYQQKPGKAPKALIYSASYRYSGVPSRFSGSGSGTDFTLTISSLQPEDFATYYCQQYNNYPFTFGQGTKLEIK

SEQ ID NO: 5942 - protein, 7 aa, synthetic construct
  REGION 1..7: note = enoblituzumab light chain CDR1
QNVDTNV

SEQ ID NO: 5943 - skipped

SEQ ID NO: 5944 - protein, 9 aa, synthetic construct
  REGION 1..9: note = enoblituzumab light chain CDR3
QQYNNYPFT

SEQ ID NO: 5945 - protein, 123 aa, synthetic construct
  REGION 1..123: note = enoticumab heavy chain V region
QVQLVESGGGVVQPGRSLRLSCAASGFTFSSYGMHWVRQAPGKGLEWVSFLWYDGTNKNYVESVKGRFTISRDNSKNMLYLEMNSLRAEDTAVYYCARDHDFRSGYEGWFDPWGQGTLVTVSS

SEQ ID NO: 5946 - protein, 7 aa, synthetic construct
  REGION 1..7: note = enoticumab heavy chain CDR1
GFTFSSY

SEQ ID NO: 5947 - protein, 8 aa, synthetic construct
  REGION 1..8: note = enoticumab heavy chain CDR2
LWYDGTNK

SEQ ID NO: 5948 - protein, 16 aa, synthetic construct
  REGION 1..16: note = enoticumab heavy chain CDR3
ARDHDFRSGYEGWFDP

SEQ ID NO: 5949 - protein, 107 aa, synthetic construct
  REGION 1..107: note = enoticumab light chain V region
EIVLTQSPATLSLSPGERATLSCRASQSVSSYLAWYQQKPGQAPRLLIYDASNRATGIPARFSGSGSGTDFTLTISSLEPEDFAVYYCQHRSNWPPTFGGGTKVEIK

SEQ ID NO: 5950 - protein, 7 aa, synthetic construct
  REGION 1..7: note = enoticumab light chain CDR1
QSVSSYL

SEQ ID NO: 5951 - skipped

SEQ ID NO: 5952 - protein, 9 aa, synthetic construct
  REGION 1..9: note = enoticumab light chain CDR3
QHRSNWPPT

SEQ ID NO: 5953 - protein, 118 aa, synthetic construct
  REGION 1..118: note = enuzovimab heavy chain V region
EVQLVESGGGLIQPGGSLRLSCAASGFIVSSNYMSWVRQAPGKGLEWVSIIYSGGSTFYADSVKGRFTISRDNSKNTLYLQMNSLRVEDTAVYYCARDLQELGSLDYWGQGTLVTVSS

SEQ ID NO: 5954 - protein, 8 aa, synthetic construct
  REGION 1..8: note = enuzovimab heavy chain CDR1
GFIVSSNY

SEQ ID NO: 5955 - protein, 7 aa, synthetic construct
  REGION 1..7: note = enuzovimab heavy chain CDR2
IYSGGST

SEQ ID NO: 5956 - protein, 12 aa, synthetic construct
  REGION 1..12: note = enuzovimab heavy chain CDR3
ARDLQELGSLDY

SEQ ID NO: 5957 - protein, 107 aa, synthetic construct
  REGION 1..107: note = enuzovimab light chain V region
DIQMTQSPSSVSASVGDRVTITCRASQGISSWLAWYQQKPGKAPKLLIYAASSLQSGVPSRFSGSGSGTDFTLTISSLQPEDFATYYCQEANSFPYTFGQGTKLEIK

SEQ ID NO: 5958 - protein, 6 aa, synthetic construct
  REGION 1..6: note = enuzovimab light chain CDR1
QGISSW

SEQ ID NO: 5959 - skipped

SEQ ID NO: 5960 - protein, 9 aa, synthetic construct
  REGION 1..9: note = enuzovimab light chain CDR3
QEANSFPYT

SEQ ID NO: 5961 - protein, 125 aa, synthetic construct
  REGION 1..125: note = epcoritamab heavy chain V region
EVKLVESGGGLVQPGGSLRLSCAASGFTFNTYAMNWVRQAPGKGLEWVARIRSKYNNYATYYADSVKDRFTISRDDSKSSLYLQMNNLKTEDTAMYYCVRHGNFGNSYVSWFAYWGQGTLVTVSS

SEQ ID NO: 5962 - protein, 8 aa, synthetic construct
  REGION 1..8: note = epcoritamab heavy chain CDR1
GFTFNTYA

SEQ ID NO: 5963 - protein, 10 aa, synthetic construct
  REGION 1..10: note = epcoritamab heavy chain CDR2
IRSKYNNYAT

SEQ ID NO: 5964 - protein, 16 aa, synthetic construct
  REGION 1..16: note = epcoritamab heavy chain CDR3
VRHGNFGNSYVSWFAY

SEQ ID NO: 5965 - protein, 109 aa, synthetic construct
  REGION 1..109: note = epcoritamab light chain V region
QAVVTQEPSFSVSPGGTVTLTCRSSTGAVTTSNYANWVQQTPGQAFRGLIGGTNKRAPGVPARFSGSLIGDKAALTITGAQADDESIYFCALWYSNLWVFGGGTKLTVL

SEQ ID NO: 5966 - protein, 9 aa, synthetic construct
  REGION 1..9: note = epcoritamab light chain CDR1
TGAVTTSNY

SEQ ID NO: 5967 - skipped

SEQ ID NO: 5968 - protein, 9 aa, synthetic construct
  REGION 1..9: note = epcoritamab light chain CDR3
ALWYSNLWV

SEQ ID NO: 5969 - protein, 111 aa, synthetic construct
  REGION 1..111: note = eptinezumab heavy chain V region
EVQLVESGGGLVQPGGSLRLSCAVSGIDLSGYYMNWVRQAPGKGLEWVGVIGINGATYYASWAKGRFTISRDNSKTTVYLQMNSLRAEDTAVYFCARGDIWGQGTLVTVSS

SEQ ID NO: 5970 - protein, 8 aa, synthetic construct
  REGION 1..8: note = eptinezumab heavy chain CDR1
GIDLSGYY

SEQ ID NO: 5971 - protein, 7 aa, synthetic construct
  REGION 1..7: note = eptinezumab heavy chain CDR2
IGINGAT

SEQ ID NO: 5972 - protein, 5 aa, synthetic construct
  REGION 1..5: note = eptinezumab heavy chain CDR3
ARGDI

SEQ ID NO: 5973 - protein, 112 aa, synthetic construct
  REGION 1..112: note = eptinezumab light chain V region
QVLTQSPSSLSASVGDRVTINCQASQSVYHNTYLAWYQQKPGKVPKQLIYDASTLASGVPSRFSGSGSGTDFTLTISSLQPEDVATYYCLGSYDCTNGDCFVFGGGTKVEIK

SEQ ID NO: 5974 - protein, 7 aa, synthetic construct
  REGION 1..7: note = eptinezumab light chain CDR1
QSVYHNT

SEQ ID NO: 5975 - skipped

SEQ ID NO: 5976 - protein, 13 aa, synthetic construct
  REGION 1..13: note = eptinezumab light chain CDR3
LGSYDCTNGDCFV

SEQ ID NO: 5977 - protein, 130 aa, synthetic construct [sequence omitted]

SEQ ID NO: 5978 - protein, 8 aa, synthetic construct
  REGION 1..8: note = erenumab heavy chain CDR1
GFTFSSFG

SEQ ID NO: 5979 - protein, 8 aa, synthetic construct
  REGION 1..8: note = erenumab heavy chain CDR2
ISFDGSIK

SEQ ID NO: 5980 - protein, 23 aa, synthetic construct
  REGION 1..23: note = erenumab heavy chain CDR3
ARDRLNYYDSSGYYHYKYYGMAV

SEQ ID NO: 5981 - protein, 110 aa, synthetic construct
  REGION 1..110: note = erenumab light chain V region
QSVLTQPPSVSAAPGQKVTISCSGSSSNIGNNYVSWYQQLPGTAPKLLIYDNNKRPSGIPDRFSGSKSGTSTTLGITGLQTGDEADYYCGTWDSRLSAVVFGGGTKLTVL

SEQ ID NO: 5982 - protein, 8 aa, synthetic construct
  REGION 1..8: note = erenumab light chain CDR1
SSNIGNNY

SEQ ID NO: 5983 - skipped

SEQ ID NO: 5984 - protein, 11 aa, synthetic construct
  REGION 1..11: note = erenumab light chain CDR3
GTWDSRLSAVV

SEQ ID NO: 5985 - protein, 117 aa, synthetic construct
  REGION 1..117: note = etaracizumab heavy chain V region
QVQLVESGGGVVQPGRSLRLSCAASGFTFSSYDMSWVRQAPGKGLEWVAKVSSGGGSTYYLDTVQGRFTISRDNSKNTLYLQMNSLRAEDTAVYYCARHLHGSFASWGQGTTVTVSS

SEQ ID NO: 5986 - protein, 8 aa, synthetic construct
  REGION 1..8: note = etaracizumab heavy chain CDR1
GFTFSSYD

SEQ ID NO: 5987 - protein, 8 aa, synthetic construct
  REGION 1..8: note = etaracizumab heavy chain CDR2
VSSGGGST

SEQ ID NO: 5988 - protein, 10 aa, synthetic construct
  REGION 1..10: note = etaracizumab heavy chain CDR3
ARHLHGSFAS

SEQ ID NO: 5989 - protein, 107 aa, synthetic construct
  REGION 1..107: note = etaracizumab light chain V region
EIVLTQSPATLSLSPGERATLSCQASQSISNFLHWYQQRPGQAPRLLIRYRSQSISGIPARFSGSGSGTDFTLTISSLEPEDFAVYYCQQSGSWPLTFGGGTKVEIK

SEQ ID NO: 5990 - protein, 6 aa, synthetic construct
  REGION 1..6: note = etaracizumab light chain CDR1
QSISNF

SEQ ID NO: 5991 - skipped

SEQ ID NO: 5992 - protein, 9 aa, synthetic construct
  REGION 1..9: note = etaracizumab light chain CDR3
QQSGSWPLT

SEQ ID NO: 5993 - protein, 119 aa, synthetic construct; identical to SEQ ID NO: 444
  REGION 1..119: note = etesevimab heavy chain V region

SEQ ID NO: 5994 - protein, 8 aa, synthetic construct
  REGION 1..8: note = etesevimab heavy chain CDR1
GFTVSSNY

SEQ ID NO: 5995 - protein, 7 aa, synthetic construct
  REGION 1..7: note = etesevimab heavy chain CDR2
IYSGGST

SEQ ID NO: 5996 - protein, 13 aa, synthetic construct
  REGION 1..13: note = etesevimab heavy chain CDR3
ARVLPMYGDYLDY

SEQ ID NO: 5997 - protein, 109 aa, synthetic construct; identical to SEQ ID NO: 443
  REGION 1..109: note = etesevimab light chain V region

SEQ ID NO: 5998 - protein, 6 aa, synthetic construct
  REGION 1..6: note = etesevimab light chain CDR1
QSISRY

SEQ ID NO: 5999 - skipped

SEQ ID NO: 6000 - protein, 11 aa, synthetic construct
  REGION 1..11: note = etesevimab light chain CDR3
QQSYSTPPEYT

SEQ ID NO: 6001 - protein, 126 aa, synthetic construct
  REGION 1..126: note = evinacumab heavy chain V region
EVQLVESGGGVIQPGGSLRLSCAASGFTFDDYAMNWVRQGPGKGLEWVSAISGDGGSTYYADSVKGRFTISRDNSKNSLYLQMNSLRAEDTAFFYCAKDLRNTIFGVVIPDAFDIWGQGTMVTVSS

SEQ ID NO: 6002 - protein, 8 aa, synthetic construct
  REGION 1..8: note = evinacumab heavy chain CDR1
GFTFDDYA

SEQ ID NO: 6003 - protein, 8 aa, synthetic construct
  REGION 1..8: note = evinacumab heavy chain CDR2
ISGDGGST

SEQ ID NO: 6004 - protein, 19 aa, synthetic construct
  REGION 1..19: note = evinacumab heavy chain CDR3
AKDLRNTIFGVVIPDAFDI

SEQ ID NO: 6005 - protein, 107 aa, synthetic construct
  REGION 1..107: note = evinacumab light chain V region
DIQMTQSPSTLSASVGDRVTITCRASQSIRSWLAWYQQKPGKAPKLLIYKASSLESGVPSRFSGSGSGTEFTLTISSLQPDDFATYYCQQYNSYSYTFGQGTKLEIK

SEQ ID NO: 6006 - protein, 6 aa, synthetic construct
  REGION 1..6: note = evinacumab light chain CDR1
QSIRSW

SEQ ID NO: 6007 - skipped

SEQ ID NO: 6008 - protein, 9 aa, synthetic construct
  REGION 1..9: note = evinacumab light chain CDR3
QQYNSYSYT

SEQ ID NO: 6009 - protein, 115 aa, synthetic construct [sequence omitted]

SEQ ID NO: 6010 - protein, 8 aa, synthetic construct
  REGION 1..8: note = evolocumab heavy chain CDR1
GYTLTSYG

SEQ ID NO: 6011 - protein, 8 aa, synthetic construct
  REGION 1..8: note = evolocumab heavy chain CDR2
VSFYNGNT

SEQ ID NO: 6012 - protein, 8 aa, synthetic construct
  REGION 1..8: note = evolocumab heavy chain CDR3
ARGYGMDV

SEQ ID NO: 6013 - protein, 109 aa, synthetic construct [sequence omitted]

SEQ ID NO: 6014 - protein, 8 aa, synthetic construct
  REGION 1..8: note = evolocumab light chain CDR1
SSDVGGYN

SEQ ID NO: 6015 - skipped

SEQ ID NO: 6016 - protein, 9 aa, synthetic construct
  REGION 1..9: note = evolocumab light chain CDR3
NSYTSTSMV

SEQ ID NO: 6017 - protein, 127 aa, synthetic construct
  REGION 1..127: note = exevolimab heavy chain V region
EVQLVESGGGLVQPGGSLRLSCAASGFTFSNYAMNWVRQAPGKGLEWVSTISGSGGATRYADSVKGRFTISRDNSRNTVYLQMNSLRVEDTAVFYCTKDRLIMATVRGPYYYGMDVWGQGTTVTVSS

SEQ ID NO: 6018 - protein, 8 aa, synthetic construct
  REGION 1..8: note = exevolimab heavy chain CDR1
GFTFSNYA

SEQ ID NO: 6019 - protein, 8 aa, synthetic construct
  REGION 1..8: note = exevolimab heavy chain CDR2
ISGSGGAT

SEQ ID NO: 6020 - protein, 20 aa, synthetic construct
  REGION 1..20: note = exevolimab heavy chain CDR3
TKDRLIMATVRGPYYYGMDV

SEQ ID NO: 6021 - protein, 107 aa, synthetic construct
  REGION 1..107: note = exevolimab light chain V region
DIQMTQSPSSLSASVGDRVTITCRASQSISSYLNWYQQKPGKAPNLLIYAASSLQSGVPSRFSGSGSETDFTLTISSLQPEDFATYYCQQSHSVSFTFGPGTKVDIK

SEQ ID NO: 6022 - protein, 6 aa, synthetic construct
  REGION 1..6: note = exevolimab light chain CDR1
QSISSY

SEQ ID NO: 6023 - skipped

SEQ ID NO: 6024 - protein, 9 aa, synthetic construct
  REGION 1..9: note = exevolimab light chain CDR3
QQSHSVSFT

SEQ ID NO: 6025 - protein, 120 aa, synthetic construct
  REGION 1..120: note = exidavnemab heavy chain V region
EVQLVESGGGLVKPGGSLRLSCAASGFTFSDYWMHWVRQAPGKGLEWVGHIKSKTDAGTTDYAAPVKGRFTISRDDSKNTLYLQMNSLKTEDTAVYYCAREIYYYAFDSWGQGTLVTVSS

SEQ ID NO: 6026 - protein, 8 aa, synthetic construct
  REGION 1..8: note = exidavnemab heavy chain CDR1
GFTFSDYW

SEQ ID NO: 6027 - protein, 10 aa, synthetic construct
  REGION 1..10: note = exidavnemab heavy chain CDR2
IKSKTDAGTT

SEQ ID NO: 6028 - protein, 11 aa, synthetic construct
  REGION 1..11: note = exidavnemab heavy chain CDR3
AREIYYYAFDS

SEQ ID NO: 6029 - protein, 107 aa, synthetic construct
  REGION 1..107: note = exidavnemab light chain V region
SYELTQPLSVSVALGQTARITCSGDNIGSKYVHWYQQKPGQAPVLVIYGDNERPSGIPERFSGSNSGNTATLTISRAQAGDEADYYCQAADWVDFYVFGGGTKLTVL

SEQ ID NO: 6030 - protein, 6 aa, synthetic construct
  REGION 1..6: note = exidavnemab light chain CDR1
NIGSKY

SEQ ID NO: 6031 - skipped

SEQ ID NO: 6032 - protein, 10 aa, synthetic construct
  REGION 1..10: note = exidavnemab light chain CDR3
QAADWVDFYV

SEQ ID NO: 6033 - protein, 123 aa, synthetic construct [sequence omitted]

SEQ ID NO: 6034 - protein, 8 aa, synthetic construct
  REGION 1..8: note = faricimab heavy chain CDR1
GYDFTHYG

SEQ ID NO: 6035 - protein, 8 aa, synthetic construct
  REGION 1..8: note = faricimab heavy chain CDR2
INTYTGEP

SEQ ID NO: 6036 - protein, 16 aa, synthetic construct
  REGION 1..16: note = faricimab heavy chain CDR3
AKYPYYYGTSHWYFDV

SEQ ID NO: 6037 - protein, 107 aa, synthetic construct [sequence omitted]

SEQ ID NO: 6038 - protein, 6 aa, synthetic construct
  REGION 1..6: note = faricimab light chain CDR1
QDISNY

SEQ ID NO: 6039 - skipped

SEQ ID NO: 6040 - protein, 9 aa, synthetic construct
  REGION 1..9: note = faricimab light chain CDR3
QQYSTVPWT

SEQ ID NO: 6041 - protein, 119 aa, synthetic construct [sequence omitted]

SEQ ID NO: 6042 - protein, 8 aa, synthetic construct
  REGION 1..8: note = fasinumab heavy chain CDR1
GFTLTELS

SEQ ID NO: 6043 - protein, 8 aa, synthetic construct
  REGION 1..8: note = fasinumab heavy chain CDR2
FDPEDGET

SEQ ID NO: 6044 - protein, 12 aa, synthetic construct
  REGION 1..12: note = fasinumab heavy chain CDR3
STIFGVVTNFDN

SEQ ID NO: 6045 - protein, 107 aa, synthetic construct [sequence omitted]

SEQ ID NO: 6046 - protein, 6 aa, synthetic construct
  REGION 1..6: note = fasinumab light chain CDR1
QAIRND

SEQ ID NO: 6047 - skipped

SEQ ID NO: 6048 - protein, 9 aa, synthetic construct
  REGION 1..9: note = fasinumab light chain CDR3
QQYNRYPWT

SEQ ID NO: 6049 - protein, 121 aa, synthetic construct
  REGION 1..121: note = fezakinumab heavy chain V region
QVQLVQSGAEVKKPGASVKVSCKASGYTFTNYYMHWVRQAPGQGLEWVGWINPYTGSAFYAQKFRGRVTMTRDTSISTAYMELSRLRSDDTAVYYCAREPEKFDSDDSDVWGRGTLVTVSS

SEQ ID NO: 6050 - protein, 8 aa, synthetic construct
  REGION 1..8: note = fezakinumab heavy chain CDR1
GYTFTNYY

SEQ ID NO: 6051 - protein, 8 aa, synthetic construct
  REGION 1..8: note = fezakinumab heavy chain CDR2
INPYTGSA

SEQ ID NO: 6052 - protein, 14 aa, synthetic construct
  REGION 1..14: note = fezakinumab heavy chain CDR3
AREPEKFDSDDSDV

SEQ ID NO: 6053 - protein, 111 aa, synthetic construct
  REGION 1..111: note = fezakinumab light chain V region
QAVLTQPPSVSGAPGQRVTISCTGSSSNIGAGYGVHWYQQLPGTAPKLLIYGDSNRPSGVPDRFSGSKSGTSASLAITGLQAEDEADYYCQSYDNSLSGYVFGGGTQLTVL

SEQ ID NO: 6054-6056 - skipped (3 entries)

SEQ ID NO: 6057 - protein, 123 aa, synthetic construct
  REGION 1..123: note = fianlimab heavy chain V region
QVQLVESGGGVVQPGRSLRLSCVASGFTFSSYGMHWVRQAPGKGLEWVAIIWYDGSNKYYADSVKGRFTISRDNSKNTQYLQMNSLRAEDTAVYYCASVATSGDFDYYGMDVWGQGTTVTVSS

SEQ ID NO: 6058 - protein, 7 aa, synthetic construct
  REGION 1..7: note = fianlimab heavy chain CDR1
GFTFSSY

SEQ ID NO: 6059 - protein, 8 aa, synthetic construct
  REGION 1..8: note = fianlimab heavy chain CDR2
IWYDGSNK

SEQ ID NO: 6060 - protein, 16 aa, synthetic construct
  REGION 1..16: note = fianlimab heavy chain CDR3
ASVATSGDFDYYGMDV

SEQ ID NO: 6061 - protein, 107 aa, synthetic construct
  REGION 1..107: note = fianlimab light chain V region
EIVLTQSPATLSLSPGERTTLSCRASQRISTYLAWYQQKPGQAPRLLIYDASKRATGIPARFSGSGSGTGFTLTISSLEPEDFAVYYCQQRSNWPLTFGGGTKVEIK

SEQ ID NO: 6062 - protein, 7 aa, synthetic construct
  REGION 1..7: note = fianlimab light chain CDR1
QRISTYL

SEQ ID NO: 6063 - skipped

SEQ ID NO: 6064 - protein, 9 aa, synthetic construct
  REGION 1..9: note = fianlimab light chain CDR3
QQRSNWPLT

SEQ ID NO: 6065 - protein, 120 aa, synthetic construct
  REGION 1..120: note = fidasimtamab heavy chain V region
QVQLVQSGAEVKKPGSSVKVSCKASGGTFSSTAISWVRQAPGQGLEWMGGIWPSFGTASYAQKFQGRVTITADESTSTAYMELSSLRSEDTAVYYCARAEYSSTGIFDYWGQGTLVTVSS

SEQ ID NO: 6066 - protein, 8 aa, synthetic construct
  REGION 1..8: note = fidasimtamab heavy chain CDR1
GGTFSSTA

SEQ ID NO: 6067 - protein, 9 aa, synthetic construct
  REGION 1..9: note = fidasimtamab heavy chain CDR2
IWPSFGTAS

SEQ ID NO: 6068 - protein, 13 aa, synthetic construct
  REGION 1..13: note = fidasimtamab heavy chain CDR3
ARAEYSSTGIFDY

SEQ ID NO: 6069 - protein, 107 aa, synthetic construct
  REGION 1..107: note = fidasimtamab light chain V region
DIQMTQSPSSVSASVGDRVTITCRASQGISSWLAWYQQKPGKAPKLLISAASSLQSGVPSRFSGSGSGTDFTLTISSLQPEDFATYYCQQANHLPFTFGGGTKVEIK

SEQ ID NO: 6070 - protein, 6 aa, synthetic construct
  REGION 1..6: note = fidasimtamab light chain CDR1
QGISSW

SEQ ID NO: 6071 - skipped

SEQ ID NO: 6072 - protein, 9 aa, synthetic construct
  REGION 1..9: note = fidasimtamab light chain CDR3
QQANHLPFT

SEQ ID NO: 6073 - protein, 125 aa, synthetic construct [sequence omitted]

SEQ ID NO: 6074 - protein, 7 aa, synthetic construct
  REGION 1..7: note = figitumumab heavy chain CDR1
GFTFSSY

SEQ ID NO: 6075 - protein, 8 aa, synthetic construct
  REGION 1..8: note = figitumumab heavy chain CDR2
ISGSGGTT

SEQ ID NO: 6076 - protein, 18 aa, synthetic construct
  REGION 1..18: note = figitumumab heavy chain CDR3
AKDLGWSDSYYYYYGMDV

SEQ ID NO: 6077 - protein, 107 aa, synthetic construct [sequence omitted]

SEQ ID NO: 6078 - protein, 6 aa, synthetic construct
  REGION 1..6: note = figitumumab light chain CDR1
QGIRND

SEQ ID NO: 6079 - skipped

SEQ ID NO: 6080 - protein, 9 aa, synthetic construct
  REGION 1..9: note = figitumumab light chain CDR3
LQHNSYPCS

SEQ ID NO: 6081 - protein, 123 aa, synthetic construct
  REGION 1..123: note = firivumab heavy chain V region
QVQLVQSGAEVKMPGSSVKVSCKTSGVFFSSHAISWVRQAPGQGLEWMGGISPMFGTTHYAQKFQGRVTITADQSTTTAYMELTSLTSEDTAVYYCARDGAGSYYPLNWFDPWGQGTLVTVSS

SEQ ID NO: 6082 - protein, 8 aa, synthetic construct
  REGION 1..8: note = firivumab heavy chain CDR1
GVFFSSHA

SEQ ID NO: 6083 - protein, 8 aa, synthetic construct
  REGION 1..8: note = firivumab heavy chain CDR2
ISPMFGTT

SEQ ID NO: 6084 - protein, 16 aa, synthetic construct
  REGION 1..16: note = firivumab heavy chain CDR3
ARDGAGSYYPLNWFDP

SEQ ID NO: 6085 - protein, 107 aa, synthetic construct
  REGION 1..107: note = firivumab light chain V region
EIVLTQSPATLSLSPGERATLSCRASENIWNNLAWYQQKPGQAPRLLISGASTGATGVPSRFRGSGSRTEFTLTISSLQSEDFAIYFCQQYNSWPRTFGPGTKVEIK

SEQ ID NO: 6086 - protein, 6 aa, synthetic construct
  REGION 1..6: note = firivumab light chain CDR1
ENIWNN

SEQ ID NO: 6087 - skipped

SEQ ID NO: 6088 - protein, 9 aa, synthetic construct
  REGION 1..9: note = firivumab light chain CDR3
QQYNSWPRT

SEQ ID NO: 6089 - protein, 119 aa, synthetic construct
  REGION 1..119: note = flanvotumab heavy chain V region
QVQLVQSGSELKKPGASVKISCKASGYTFTSYAMNWVRQAPGQGLESMGWINTNTGNPTYAQGFTGRFVFSMDTSVSTAYLQISSLKAEDTAIYYCAPRYSSSWYLDYWGQGTLVTVSS

SEQ ID NO: 6090 - protein, 7 aa, synthetic construct
  REGION 1..7: note = flanvotumab heavy chain CDR1
GYTFTSY

SEQ ID NO: 6091 - protein, 8 aa, synthetic construct
  REGION 1..8: note = flanvotumab heavy chain CDR2
INTNTGNP

SEQ ID NO: 6092 - protein, 12 aa, synthetic construct
  REGION 1..12: note = flanvotumab heavy chain CDR3
APRYSSSWYLDY

SEQ ID NO: 6093 - protein, 108 aa, synthetic construct
  REGION 1..108: note = flanvotumab light chain V region
EIVLTQSPATLSLSPGERATLSCRASQSVSSYLAWYQQKPGQAPRLLIYDASNRATGIPARFSGSGSGTDFTLTISSLEPEDFAVYYCQQRSNWLMYTFGQGTKLEIK

SEQ ID NO: 6094 - protein, 6 aa, synthetic construct
  REGION 1..6: note = flanvotumab light chain CDR1
QSVSSY

SEQ ID NO: 6095 - skipped

SEQ ID NO: 6096 - protein, 10 aa, synthetic construct
  REGION 1..10: note = flanvotumab light chain CDR3
QQRSNWLMYT

SEQ ID NO: 6097 - protein, 127 aa, synthetic construct [sequence omitted]

SEQ ID NO: 6098 - protein, 8 aa, synthetic construct
  REGION 1..8: note = fletikumab heavy chain CDR1
GYTFTNDI

SEQ ID NO: 6099 - protein, 8 aa, synthetic construct
  REGION 1..8: note = fletikumab heavy chain CDR2
INAGYGNT

SEQ ID NO: 6100 - protein, 20 aa, synthetic construct
  REGION 1..20: note = fletikumab heavy chain CDR3
AREPLWFGESSPHDYYGMDV

SEQ ID NO: 6101 - protein, 107 aa, synthetic construct [sequence omitted]

SEQ ID NO: 6102 - protein, 6 aa, synthetic construct
  REGION 1..6: note = fletikumab light chain CDR1
QGISSA

SEQ ID NO: 6103 - skipped

SEQ ID NO: 6104 - protein, 9 aa, synthetic construct
  REGION 1..9: note = fletikumab light chain CDR3
QQFNSYPLT

SEQ ID NO: 6105 - protein, 118 aa, synthetic construct [sequence omitted]

SEQ ID NO: 6106 - protein, 8 aa, synthetic construct
  REGION 1..8: note = foralumab heavy chain CDR1
GFKFSGYG

SEQ ID NO: 6107 - protein, 8 aa, synthetic construct
  REGION 1..8: note = foralumab heavy chain CDR2
IWYDGSKK

SEQ ID NO: 6108 - protein, 11 aa, synthetic construct
  REGION 1..11: note = foralumab heavy chain CDR3
ARQMGYWHFDL

SEQ ID NO: 6109 - protein, 108 aa, synthetic construct [sequence omitted]

SEQ ID NO: 6110 - protein, 6 aa, synthetic construct
  REGION 1..6: note = foralumab light chain CDR1
QSVSSY

SEQ ID NO: 6111 - skipped

SEQ ID NO: 6112 - protein, 10 aa, synthetic construct
  REGION 1..10: note = foralumab light chain CDR3
QQRSNWPPLT

SEQ ID NO: 6113 - protein, 119 aa, synthetic construct
  REGION 1..119: note = foravirumab heavy chain V region
QVQLVESGGGAVQPGRSLRLSCAASGFTFSSYGMHWVRQAPGKGLEWVAVILYDGSDKFYADSVKGRFTISRDNSKNTLYLQMNSLRAEDTAVYYCAKVAVAGTHFDYWGQGTLVTVSS

SEQ ID NO: 6114 - protein, 7 aa, synthetic construct
  REGION 1..7: note = foravirumab heavy chain CDR1
GFTFSSY

SEQ ID NO: 6115 - protein, 8 aa, synthetic construct
  REGION 1..8: note = foravirumab heavy chain CDR2
ILYDGSDK

SEQ ID NO: 6116 - protein, 12 aa, synthetic construct
  REGION 1..12: note = foravirumab heavy chain CDR3
AKVAVAGTHFDY

SEQ ID NO: 6117 - protein, 107 aa, synthetic construct
  REGION 1..107: note = foravirumab light chain V region
DIQMTQSPSSLSASVGDRVTITCRASQGIRNDLGWYQQKPGKAPKLLIYAASSLQSGVPSRFSGSGSGTDFTLTISSLQPEDFATYYCQQLNSYPPTFGGGTKVEIK

SEQ ID NO: 6118 - protein, 6 aa, synthetic construct
  REGION 1..6: note = foravirumab light chain CDR1
QGIRND

SEQ ID NO: 6119 - skipped

SEQ ID NO: 6120 - protein, 9 aa, synthetic construct
  REGION 1..9: note = foravirumab light chain CDR3
QQLNSYPPT

SEQ ID NO: 6121 - protein, 122 aa, synthetic construct
  REGION 1..122: note = fremanezumab heavy chain V region
EVQLVESGGGLVQPGGSLRLSCAASGFTFSNYWISWVRQAPGKGLEWVAEIRSESDASATHYAEAVKGRFTISRDNAKNSLYLQMNSLRAEDTAVYYCLAYFDYGLAIQNYWGQGTLVTVSS

SEQ ID NO: 6122 - protein, 8 aa, synthetic construct
  REGION 1..8: note = fremanezumab heavy chain CDR1
GFTFSNYW

SEQ ID NO: 6123 - protein, 10 aa, synthetic construct
  REGION 1..10: note = fremanezumab heavy chain CDR2
IRSESDASAT

SEQ ID NO: 6124 - protein, 13 aa, synthetic construct
  REGION 1..13: note = fremanezumab heavy chain CDR3
LAYFDYGLAIQNY

SEQ ID NO: 6125 - protein, 107 aa, synthetic construct
  REGION 1..107: note = fremanezumab light chain V region
EIVLTQSPATLSLSPGERATLSCKASKRVTTYVSWYQQKPGQAPRLLIYGASNRYLGIPARFSGSGSGTDFTLTISSLEPEDFAVYYCSQSYNYPYTFGQGTKLEIK

SEQ ID NO: 6126 - protein, 6 aa, synthetic construct
  REGION 1..6: note = fremanezumab light chain CDR1
KRVTTY

SEQ ID NO: 6127 - skipped

SEQ ID NO: 6128 - protein, 9 aa, synthetic construct
  REGION 1..9: note = fremanezumab light chain CDR3
SQSYNYPYT

SEQ ID NO: 6129 - protein, 120 aa, synthetic construct
  REGION 1..120: note = fresolimumab heavy chain V region
QVQLVQSGAEVKKPGSSVKVSCKASGYTFSSNVISWVRQAPGQGLEWMGGVIPIVDIANYAQRFKGRVTITADESTSTTYMELSSLRSEDTAVYYCASTLGLVLDAMDYWGQGTLVTVSS

SEQ ID NO: 6130 - protein, 8 aa, synthetic construct
  REGION 1..8: note = fresolimumab heavy chain CDR1
GYTFSSNV

SEQ ID NO: 6131 - protein, 8 aa, synthetic construct
  REGION 1..8: note = fresolimumab heavy chain CDR2
VIPIVDIA

SEQ ID NO: 6132 - protein, 13 aa, synthetic construct
  REGION 1..13: note = fresolimumab heavy chain CDR3
ASTLGLVLDAMDY

SEQ ID NO: 6133 - protein, 108 aa, synthetic construct
  REGION 1..108: note = fresolimumab light chain V region
ETVLTQSPGTLSLSPGERATLSCRASQSLGSSYLAWYQQKPGQAPRLLIYGASSRAPGIPDRFSGSGSGTDFTLTISRLEPEDFAVYYCQQYADSPITFGQGTRLEIK

SEQ ID NO: 6134 - protein, 6 aa, synthetic construct
  REGION 1..6: note = fresolimumab light chain CDR1
QSLGSS

SEQ ID NO: 6135 - skipped

SEQ ID NO: 6136 - protein, 9 aa, synthetic construct
  REGION 1..9: note = fresolimumab light chain CDR3
QQYADSPIT

SEQ ID NO: 6137 - protein, 123 aa, synthetic construct
  REGION 1..123: note = fulranumab heavy chain V region
EVQLVESGGGLVQPGGSLRLSCAASGFTLRSYSMNWVRQAPGKGLEWVSYISRSSHTIFYADSVKGRFTISRDNAKNSLYLQMDSLRDEDTAMYYCARVYSSGWHVSDYFDYWGQGILVTVSS

SEQ ID NO: 6138 - protein, 8 aa, synthetic construct
  REGION 1..8: note = fulranumab heavy chain CDR1
GFTLRSYS

SEQ ID NO: 6139 - protein, 8 aa, synthetic construct
  REGION 1..8: note = fulranumab heavy chain CDR2
ISRSSHTI

SEQ ID NO: 6140 - protein, 16 aa, synthetic construct
  REGION 1..16: note = fulranumab heavy chain CDR3
ARVYSSGWHVSDYFDY

SEQ ID NO: 6141 - protein, 107 aa, synthetic construct [sequence omitted]

SEQ ID NO: 6142 - protein, 6 aa, synthetic construct
  REGION 1..6: note = fulranumab light chain CDR1
QGISSA

SEQ ID NO: 6143 - skipped

SEQ ID NO: 6144 - protein, 9 aa, synthetic construct
  REGION 1..9: note = fulranumab light chain CDR3
QQFNSYPLT

SEQ ID NO: 6145 - protein, 119 aa, synthetic construct
  REGION 1..119: note = galcanezumab heavy chain V region
QVQLVQSGAEVKKPGSSVKVSCKASGYTFGNYWMQWVRQAPGQGLEWMGAIYEGTGKTVYIQKFADRVTITADKSTSTAYMELSSLRSEDTAVYYCARLSDYVSGFGYWGQGTTVTVSS

SEQ ID NO: 6146 - protein, 8 aa, synthetic construct
  REGION 1..8: note = galcanezumab heavy chain CDR1
GYTFGNYW

SEQ ID NO: 6147 - protein, 8 aa, synthetic construct
  REGION 1..8: note = galcanezumab heavy chain CDR2
IYEGTGKT

SEQ ID NO: 6148 - protein, 12 aa, synthetic construct
  REGION 1..12: note = galcanezumab heavy chain CDR3
ARLSDYVSGFGY

SEQ ID NO: 6149 - protein, 107 aa, synthetic construct
  REGION 1..107: note = galcanezumab light chain V region
DIQMTQSPSSLSASVGDRVTITCRASKDISKYLNWYQQKPGKAPKLLIYYTSGYHSGVPSRFSGSGSGTDFTLTISSLQPEDFATYYCQQGDALPPTFGGGTKVEIK

SEQ ID NO: 6150 - protein, 6 aa, synthetic construct
  REGION 1..6: note = galcanezumab light chain CDR1
KDISKY

SEQ ID NO: 6151 - skipped

SEQ ID NO: 6152 - protein, 9 aa, synthetic construct
  REGION 1..9: note = galcanezumab light chain CDR3
QQGDALPPT

SEQ ID NO: 6153 - protein, 119 aa, synthetic construct [sequence omitted]

SEQ ID NO: 6154 - protein, 9 aa, synthetic construct
  REGION 1..9: note = ganitumab heavy chain CDR1
GGSISSSNW

SEQ ID NO: 6155 - protein, 7 aa, synthetic construct
  REGION 1..7: note = ganitumab heavy chain CDR2
IYHSGST

SEQ ID NO: 6156 - protein, 12 aa, synthetic construct
  REGION 1..12: note = ganitumab heavy chain CDR3
ARWTGRTDAFDI

SEQ ID NO: 6157 - protein, 112 aa, synthetic construct [sequence omitted]

SEQ ID NO: 6158 - protein, 11 aa, synthetic construct
  REGION 1..11: note = ganitumab light chain CDR1
QSLLHSNGYNY

SEQ ID NO: 6159 - skipped

SEQ ID NO: 6160 - protein, 9 aa, synthetic construct
  REGION 1..9: note = ganitumab light chain CDR3
MQGTHWPLT

SEQ ID NO: 6161 - protein, 126 aa, synthetic construct [sequence omitted]

SEQ ID NO: 6162 - protein, 7 aa, synthetic construct
  REGION 1..7: note = gantenerumab heavy chain CDR1
GFTFSSY

SEQ ID NO: 6163 - protein, 8 aa, synthetic construct
  REGION 1..8: note = gantenerumab heavy chain CDR2
INASGTRT

SEQ ID NO: 6164 - protein, 19 aa, synthetic construct
  REGION 1..19: note = gantenerumab heavy chain CDR3
ARGKGNTHKPYGYVRYFDV

SEQ ID NO: 6165 - protein, 108 aa, synthetic construct [sequence omitted]

SEQ ID NO: 6166 - protein, 7 aa, synthetic construct
  REGION 1..7: note = gantenerumab light chain CDR1
QSVSSSY

SEQ ID NO: 6167 - skipped

SEQ ID NO: 6168 - protein, 9 aa, synthetic construct
  REGION 1..9: note = gantenerumab light chain CDR3
LQIYNMPIT

SEQ ID NO: 6169 - protein, 117 aa, synthetic construct
  REGION 1..117: note = garivulimab heavy chain V region
EVQLVESGGGLVQPGGSLRLSCAVSGFSLTSYGVHWVRQAPGKGLEWVAVIWAGGSTNYADSVKGRFTISKDTSKNTVYLQMNSLRAEDTAVYYCAKPYGTSAMDYWGQGTLVTVSS

SEQ ID NO: 6170 - protein, 8 aa, synthetic construct
  REGION 1..8: note = garivulimab heavy chain CDR1
GFSLTSYG

SEQ ID NO: 6171 - protein, 7 aa, synthetic construct
  REGION 1..7: note = garivulimab heavy chain CDR2
IWAGGST

SEQ ID NO: 6172 - protein, 11 aa, synthetic construct
  REGION 1..11: note = garivulimab heavy chain CDR3
AKPYGTSAMDY

SEQ ID NO: 6173 - protein, 108 aa, synthetic construct
  REGION 1..108: note = garivulimab light chain V region
DIQMTQSPSSLSASVGDRVTITCKASQDVGIVVAWYQQKPGKAPKLLIYWASIRHTGVPSRFSGSGSGTEFTLTISSLQPDDFATYYCQQYSNYPLYTFGQGTKVEIK

SEQ ID NO: 6174 - protein, 6 aa, synthetic construct
  REGION 1..6: note = garivulimab light chain CDR1
QDVGIV

SEQ ID NO: 6175 - skipped

SEQ ID NO: 6176 - protein, 10 aa, synthetic construct
  REGION 1..10: note = garivulimab light chain CDR3
QQYSNYPLYT

SEQ ID NO: 6177 - protein, 125 aa, synthetic construct
  REGION 1..125: note = gedivumab heavy chain V region
EVQLVESGGGVVQPGKSLRLSCAASGLTFSSYAVHWVRQAPGKGLEWVTLISYDGANQYYADSVKGRFTISRDNSKNTVYLQMNSLRPEDTAVYYCAVPGPVFGIFPPWSYFDNWGQGILVTVSS

SEQ ID NO: 6178 - protein, 7 aa, synthetic construct
  REGION 1..7: note = gedivumab heavy chain CDR1
GLTFSSY

SEQ ID NO: 6179 - protein, 8 aa, synthetic construct
  REGION 1..8: note = gedivumab heavy chain CDR2
ISYDGANQ

SEQ ID NO: 6180 - protein, 18 aa, synthetic construct
  REGION 1..18: note = gedivumab heavy chain CDR3
AVPGPVFGIFPPWSYFDN

SEQ ID NO: 6181 - protein, 109 aa, synthetic construct
  REGION 1..109: note = gedivumab light chain V region
EIVLTQSPATLSVSPGERATLSCRASQVISHNLAWYQQKPGQAPRLLIYGASTRASGIPARFSGSGSGTDYTLTITSLQSEDFAVYYCQHYSNWPPRLTFGGGTKVEIK

SEQ ID NO: 6182 - protein, 6 aa, synthetic construct
  REGION 1..6: note = gedivumab light chain CDR1
QVISHN

SEQ ID NO: 6183 - skipped

SEQ ID NO: 6184 - protein, 11 aa, synthetic construct
  REGION 1..11: note = gedivumab light chain CDR3
QHYSNWPPRLT

SEQ ID NO: 6185 - protein, 116 aa, synthetic construct [sequence omitted]

SEQ ID NO: 6186 - protein, 8 aa, synthetic construct
  REGION 1..8: note = gemtuzumab ozogamicin heavy chain CDR1
GYTITDSN

SEQ ID NO: 6187 - protein, 8 aa, synthetic construct
  REGION 1..8: note = gemtuzumab ozogamicin heavy chain CDR2
IYPYNGGT

SEQ ID NO: 6188 - protein, 9 aa, synthetic construct
  REGION 1..9: note = gemtuzumab ozogamicin heavy chain CDR3
VNGNPWLAY

SEQ ID NO: 6189 - protein, 111 aa, synthetic construct [sequence omitted]

SEQ ID NO: 6190 - protein, 10 aa, synthetic construct
  REGION 1..10: note = gemtuzumab ozogamicin light chain CDR1
ESLDNYGIRF

SEQ ID NO: 6191 - skipped

SEQ ID NO: 6192 - protein, 9 aa, synthetic construct
  REGION 1..9: note = gemtuzumab ozogamicin light chain CDR3
QQTKEVPWS

SEQ ID NO: 6193 - protein, 120 aa, synthetic construct [sequence omitted]

SEQ ID NO: 6194 - protein, 10 aa, synthetic construct
  REGION 1..10: note = gevokizumab heavy chain CDR1
GFSLSTSGMG

SEQ ID NO: 6195 - protein, 7 aa, synthetic construct
  REGION 1..7: note = gevokizumab heavy chain CDR2
IWWDGDE

SEQ ID NO: 6196 - protein, 12 aa, synthetic construct
  REGION 1..12: note = gevokizumab heavy chain CDR3
ARNRYDPPWFVD

SEQ ID NO: 6197 - protein, 107 aa, synthetic construct [sequence omitted]

SEQ ID NO: 6198 - protein, 6 aa, synthetic construct
  REGION 1..6: note = gevokizumab light chain CDR1
QDISNY

SEQ ID NO: 6199 - skipped

SEQ ID NO: 6200 - protein, 9 aa, synthetic construct
  REGION 1..9: note = gevokizumab light chain CDR3
LQGKMLPWT

SEQ ID NO: 6201 - protein, 121 aa, synthetic construct
  REGION 1..121: note = gimsilumab heavy chain V region
EVQLVESGGGLVQPGGSLRLSCAASGFTFSRHWMHWLRQVPGKGPVWVSRINGAGTSITYADSVRGRFTISRDNANNTLFLQMNSLRADDTALYFCARANSVWFRGLFDYWGQGTPVTVSS

SEQ ID NO: 6202 - protein, 8 aa, synthetic construct
  REGION 1..8: note = gimsilumab heavy chain CDR1
GFTFSRHW

SEQ ID NO: 6203 - protein, 8 aa, synthetic construct
  REGION 1..8: note = gimsilumab heavy chain CDR2
INGAGTSI

SEQ ID NO: 6204 - protein, 14 aa, synthetic construct
  REGION 1..14: note = gimsilumab heavy chain CDR3
ARANSVWFRGLFDY

SEQ ID NO: 6205 - protein, 107 aa, synthetic construct
  REGION 1..107: note = gimsilumab light chain V region
EIVLTQSPVTLSVSPGERVTLSCRASQSVSTNLAWYQQKLGQGPRLLIYGASTRATDIPARFSGSGSETEFTLTISSLQSEDFAVYYCQQYDKWPDTFGQGTKLEIK

SEQ ID NO: 6206 - protein, 6 aa, synthetic construct
  REGION 1..6: note = gimsilumab light chain CDR1
QSVSTN

SEQ ID NO: 6207 - skipped

SEQ ID NO: 6208 - protein, 9 aa, synthetic construct
  REGION 1..9: note = gimsilumab light chain CDR3
QQYDKWPDT

SEQ ID NO: 6209 - protein, 124 aa, synthetic construct
  REGION 1..124: note = ginisortamab heavy chain V region
QVQLVESGAEVKKPGATVKISCKVSGYTFTDYYMHWVQQAPGKGLEWMGLVDPEDGETIYAEKFQGRVTITADTSTDTAYMELSSLRSEDTAVYYCATDARGSGSYYPNHFDYWGQGTLVTVSS

SEQ ID NO: 6210 - protein, 8 aa, synthetic construct
  REGION 1..8: note = ginisortamab heavy chain CDR1
GYTFTDYY

SEQ ID NO: 6211 - protein, 8 aa, synthetic construct
  REGION 1..8: note = ginisortamab heavy chain CDR2
VDPEDGET

SEQ ID NO: 6212 - protein, 14 aa, synthetic construct
  REGION 1..14: note = ginisortamab heavy chain CDR3
ARGSGSYYPNHFDY

SEQ ID NO: 6213 - protein, 112 aa, synthetic construct
  REGION 1..112: note = ginisortamab light chain V region
DIVMTQSPDSLAVSLGERATINCKSSQSVLYSSNNKNYLAWYQQKPGQPPKLLIYWASTRESGVPDRFSGSGSGTDFTLTINSLQAEDVAVYFCQQYYDTPTFGQGTRLEIK

SEQ ID NO: 6214 - protein, 12 aa, synthetic construct
  REGION 1..12: note = ginisortamab light chain CDR1
QSVLYSSNNKNY

SEQ ID NO: 6215 - skipped

SEQ ID NO: 6216 - protein, 8 aa, synthetic construct
  REGION 1..8: note = ginisortamab light chain CDR3
QQYYDTPT

SEQ ID NO: 6217 - protein, 119 aa, synthetic construct [sequence omitted]

SEQ ID NO: 6218 - protein, 10 aa, synthetic construct
  REGION 1..10: note = glembatumumab heavy chain CDR1
GGSISSFNYY

SEQ ID NO: 6219 - protein, 10 aa, synthetic construct
  REGION 1..10: note = glembatumumab heavy chain CDR2
IGYIYYSGST

SEQ ID NO: 6220 - protein, 11 aa, synthetic construct
  REGION 1..11: note = glembatumumab heavy chain CDR3
ARGYNWNYFDY

SEQ ID NO: 6221 - protein, 108 aa, synthetic construct [sequence omitted]

SEQ ID NO: 6222 - protein, 7 aa, synthetic construct
  REGION 1..7: note = glembatumumab light chain CDR1
QSVDNNL

SEQ ID NO: 6223 - skipped

SEQ ID NO: 6224 - protein, 10 aa, synthetic construct [sequence omitted]

SEQ ID NO: 6225 - protein, 119 aa, synthetic construct [sequence omitted]

SEQ ID NO: 6226 - protein, 10 aa, synthetic construct
  REGION 1..10: note = glembatumumab vedotin heavy chain CDR1
GGSISSFNYY

SEQ ID NO: 6227 - protein, 10 aa, synthetic construct
  REGION 1..10: note = glembatumumab vedotin heavy chain CDR2
IGYIYYSGST

SEQ ID NO: 6228 - protein, 11 aa, synthetic construct
  REGION 1..11: note = glembatumumab vedotin heavy chain CDR3
ARGYNWNYFDY

SEQ ID NO: 6229 - protein, 108 aa, synthetic construct [sequence omitted]

SEQ ID NO: 6230 - protein, 7 aa, synthetic construct
  REGION 1..7: note = glembatumumab vedotin light chain CDR1
QSVDNNL

SEQ ID NO: 6231 - skipped

SEQ ID NO: 6232 - protein, 10 aa, synthetic construct [sequence omitted]

SEQ ID NO: 6233 - protein, 117 aa, synthetic construct
  REGION 1..117: note = gosuranemab heavy chain V region
EVHLVESGGALVKPGGSLRLSCAASGFSFSKYGMSWVRQAPGKGLEWVATISSSGSRTYYPDSVKGRFTISRDNAKNTLYLQMNSLRAEDTAMYYCSISWDGAMDYWGQGTTVTVSS

SEQ ID NO: 6234 - protein, 8 aa, synthetic construct
  REGION 1..8: note = gosuranemab heavy chain CDR1
GFSFSKYG

SEQ ID NO: 6235 - protein, 8 aa, synthetic construct
  REGION 1..8: note = gosuranemab heavy chain CDR2
ISSSGSRT

SEQ ID NO: 6236 - protein, 10 aa, synthetic construct
  REGION 1..10: note = gosuranemab heavy chain CDR3
SISWDGAMDY

SEQ ID NO: 6237 - protein, 112 aa, synthetic construct
  REGION 1..112: note = gosuranemab light chain V region
DVVMTQSPLSLPVTLGQPASISCKSSQSIVHSNGNTYLEWYLQKPGQSPQLLVYKVSNRFSGVPDRFSGSGSGTDFTLKISRVEAEDVGTYYCFQGSLVPWAFGGGTKVEIK

SEQ ID NO: 6238 - protein, 11 aa, synthetic construct
  REGION 1..11: note = gosuranemab light chain CDR1
QSIVHSNGNTY

SEQ ID NO: 6239 - skipped

SEQ ID NO: 6240 - protein, 9 aa, synthetic construct
  REGION 1..9: note = gosuranemab light chain CDR3
FQGSLVPWA

SEQ ID NO: 6241 - protein, 124 aa, synthetic construct
  REGION 1..124: note = gremubamab heavy chain V region
EVQLLESGGGLVQPGGSLRLSCAASGFTFSSYAMNWVRQAPGKGLEWVSAITMSGITAYYTDDVKGRFTISRDNSKNTLYLQMNSLRAEDTAVYYCAKEEFLPGTHYYYGMDVWGQGTTVTVSS

SEQ ID NO: 6242 - protein, 7 aa, synthetic construct
  REGION 1..7: note = gremubamab heavy chain CDR1
GFTFSSY

SEQ ID NO: 6243 - protein, 8 aa, synthetic construct
  REGION 1..8: note = gremubamab heavy chain CDR2
ITMSGITA

SEQ ID NO: 6244 - protein, 17 aa, synthetic construct
  REGION 1..17: note = gremubamab heavy chain CDR3
AKEEFLPGTHYYYGMDV

SEQ ID NO: 6245 - protein, 107 aa, synthetic construct
  REGION 1..107: note = gremubamab light chain V region
AIQMTQSPSSLSASVGDRVTITCRASQGIRNDLGWYQQKPGKAPKLLIYSASTLQSGVPSRFSGSGSGTDFTLTISSLQPEDFATYYCLQDYNYPWTFGQGTKVEIK

SEQ ID NO: 6246 - protein, 6 aa, synthetic construct
  REGION 1..6: note = gremubamab light chain CDR1
QGIRND

SEQ ID NO: 6247 - skipped

SEQ ID NO: 6248 - protein, 9 aa, synthetic construct
  REGION 1..9: note = gremubamab light chain CDR3
LQDYNYPWT

SEQ ID NO: 6249 - protein, 125 aa, synthetic construct
  REGION 1..125: note = gresonitamab heavy chain 1 V region
QVQLVQSGAEVKKPGASVKVSCKASGYTFTGYYMHWVRQAPGQCLEWMGWINPNSGGTKYAQKFQGRVTMTRDTSISTAYMELSRLRSDDTAVYYCARDRITVAGTYYYYGMDVWGQGTTVTVSS

SEQ ID NO: 6250 - protein, 8 aa, synthetic construct
  REGION 1..8: note = gresonitamab heavy chain 1 CDR1
GYTFTGYY

SEQ ID NO: 6251 - protein, 9 aa, synthetic construct
  REGION 1..9: note = gresonitamab heavy chain 1 CDR2
INPNSGGTK

SEQ ID NO: 6252 - protein, 18 aa, synthetic construct
  REGION 1..18: note = gresonitamab heavy chain 1 CDR3
ARDRITVAGTYYYYGMDV

SEQ ID NO: 6253 - protein, 107 aa, synthetic construct
  REGION 1..107: note = gresonitamab light chain 1 V region
DIQMTQSPSSVSASVGDRVTITCRASQGVNNWLAWYQQKPGKAPKLLIYTASSLQSGVPSRFSGSGSGTDFTLTIRSLQPEDFATYYCQQANSFPITFGCGTRLEIK

SEQ ID NO: 6254 - protein, 6 aa, synthetic construct
  REGION 1..6: note = gresonitamab light chain 1 CDR1
QGVNNW

SEQ ID NO: 6255 - skipped

SEQ ID NO: 6256 - protein, 9 aa, synthetic construct
  REGION 1..9: note = gresonitamab light chain 1 CDR3
QQANSFPIT

SEQ ID NO: 6257 - protein, 125 aa, synthetic construct
  REGION 1..125: note = gresonitamab heavy chain 2 V region
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 6258 - protein, 8 aa, synthetic construct
  REGION 1..8: note = gresonitamab heavy chain 2 CDR1
GFTFNKYA

SEQ ID NO: 6259 - protein, 10 aa, synthetic construct
  REGION 1..10: note = gresonitamab heavy chain 2 CDR2
IRSKYNNYAT

SEQ ID NO: 6260 - protein, 16 aa, synthetic construct
  REGION 1..16: note = gresonitamab heavy chain 2 CDR3
VRHGNFGNSYISYWAY

SEQ ID NO: 6261 - protein, 109 aa, synthetic construct
  REGION 1..109: note = gresonitamab light chain 2 V region
QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 6262 - protein, 9 aa, synthetic construct
  REGION 1..9: note = gresonitamab light chain 2 CDR1
TGAVTSGNY

SEQ ID NO: 6263 - skipped

SEQ ID NO: 6264 - protein, 9 aa, synthetic construct
  REGION 1..9: note = gresonitamab light chain 2 CDR3
VLWYSNRWV

SEQ ID NO: 6265 - protein, 117 aa, synthetic construct
  REGION 1..117: note = guselkumab heavy chain V region
EVQLVQSGAEVKKPGESLKISCKGSGYSFSNYWIGWVRQMPGKGLEWMGIIDPSNSYTRYSPSFQGQVTISADKSISTAYLQWSSLKASDTAMYYCARWYYKPFDVWGQGTLVTVSS

SEQ ID NO: 6266 - protein, 7 aa, synthetic construct
  REGION 1..7: note = guselkumab heavy chain CDR1
GYSFSNY

SEQ ID NO: 6267 - protein, 8 aa, synthetic construct
  REGION 1..8: note = guselkumab heavy chain CDR2
IDPSNSYT

SEQ ID NO: 6268 - protein, 10 aa, synthetic construct
  REGION 1..10: note = guselkumab heavy chain CDR3
ARWYYKPFDV

SEQ ID NO: 6269 - protein, 111 aa, synthetic construct
  REGION 1..111: note = guselkumab light chain V region
QSVLTQPPSVSGAPGQRVTISCTGSSSNIGSGYDVHWYQQLPGTAPKLLIYGNSKRPSGVPDRFSGSKSGTSASLAITGLQSEDEADYYCASWTDGLSLVVFGGGTKLTVL

SEQ ID NO: 6270 - protein, 9 aa, synthetic construct
  REGION 1..9: note = guselkumab light chain CDR1
SSNIGSGYD

SEQ ID NO: 6271 - skipped

SEQ ID NO: 6272 - protein, 11 aa, synthetic construct
  REGION 1..11: note = guselkumab light chain CDR3
ASWTDGLSLVV

SEQ ID NO: 6273 - protein, 124 aa, synthetic construct
  REGION 1..124: note = ianalumab heavy chain V region
QVQLQQSGPGLVKPSQTLSLTCAISGDSVSSNSAAWGWIRQSPGRGLEWLGRIYYRSKWYNSYAVSVKSRITINPDTSKNQFSLQLNSVTPEDTAVYYCARYQWVPKIGVFDSWGQGTLVTVSS

SEQ ID NO: 6274 - protein, 10 aa, synthetic construct
  REGION 1..10: note = ianalumab heavy chain CDR1
GDSVSSNSAA

SEQ ID NO: 6275 - protein, 10 aa, synthetic construct
  REGION 1..10: note = ianalumab heavy chain CDR2
IYYRSKWYNS

SEQ ID NO: 6276 - protein, 14 aa, synthetic construct
  REGION 1..14: note = ianalumab heavy chain CDR3
ARYQWVPKIGVFDS

SEQ ID NO: 6277 - protein, 108 aa, synthetic construct
  REGION 1..108: note = ianalumab light chain V region
DIVLTQSPATLSLSPGERATLSCRASQFILPEYLSWYQQKPGQAPRLLIYGSSSRATGVPARFSGSGSGTDFTLTISSLEPEDFAVYYCQQFYSSPLTFGQGTKVEIK

SEQ ID NO: 6278 - protein, 7 aa, synthetic construct
  REGION 1..7: note = ianalumab light chain CDR1
QFILPEY

SEQ ID NO: 6279 - skipped

SEQ ID NO: 6280 - protein, 9 aa, synthetic construct
  REGION 1..9: note = ianalumab light chain CDR3
QQFYSSPLT

SEQ ID NO: 6281 - protein, 116 aa, synthetic construct [sequence omitted]

SEQ ID NO: 6282 - protein, 8 aa, synthetic construct
  REGION 1..8: note = ibalizumab heavy chain CDR1
GYTITDSN

SEQ ID NO: 6283 - protein, 8 aa, synthetic construct
  REGION 1..8: note = ibalizumab heavy chain CDR2
IYPYNGGT

SEQ ID NO: 6284 - protein, 9 aa, synthetic construct
  REGION 1..9: note = ibalizumab heavy chain CDR3
VNGNPWLAY

SEQ ID NO: 6285 - protein, 111 aa, synthetic construct [sequence omitted]

SEQ ID NO: 6286 - protein, 10 aa, synthetic construct
  REGION 1..10: note = ibalizumab light chain CDR1
ESLDNYGIRF

SEQ ID NO: 6287 - skipped

SEQ ID NO: 6288 - protein, 8 aa, synthetic construct
  REGION 1..8: note = ibalizumab light chain CDR3
QQTKEVPW

SEQ ID NO: 6289 - protein, 122 aa, synthetic construct
  REGION 1..122: note = ibritumomab tiuxetan heavy chain V region
QVQLQQSGPEVVKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSS

SEQ ID NO: 6290 - protein, 8 aa, synthetic construct
  REGION 1..8: note = ibritumomab tiuxetan heavy chain CDR1
GYTFTSYV

SEQ ID NO: 6291 - protein, 8 aa, synthetic construct
  REGION 1..8: note = ibritumomab tiuxetan heavy chain CDR2
INPYNDGT

SEQ ID NO: 6292 - protein, 15 aa, synthetic construct
  REGION 1..15: note = ibritumomab tiuxetan heavy chain CDR3
AREKDNYATGAWFAY

SEQ ID NO: 6293 - protein, 112 aa, synthetic construct
  REGION 1..112: note = ibritumomab tiuxetan light chain V region
DIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIK

SEQ ID NO: 6294 - protein, 12 aa, synthetic construct
  REGION 1..12: note = ibritumomab tiuxetan light chain CDR1
QSLLYSTNQKNY

SEQ ID NO: 6295 - skipped

SEQ ID NO: 6296 - protein, 8 aa, synthetic construct
  REGION 1..8: note = ibritumomab tiuxetan light chain CDR3
QQYYSYRT

SEQ ID NO: 6297 - protein, 126 aa, synthetic construct
  REGION 1..126: note = icrucumab heavy chain V region
QAQVVESGGGVVQSGRSLRLSCAASGFAFSSYGMHWVRQAPGKGLEWVAVIWYDGSNKYYADSVRGRFTISRDNSENTLYLQMNSLRAEDTAVYYCARDHYGSGVHHYFYYGLDVWGQGTTVTVSS

SEQ ID NO: 6298 - protein, 7 aa, synthetic construct
  REGION 1..7: note = icrucumab heavy chain CDR1
GFAFSSY

SEQ ID NO: 6299 - protein, 8 aa, synthetic construct
  REGION 1..8: note = icrucumab heavy chain CDR2
IWYDGSNK

SEQ ID NO: 6300 - protein, 19 aa, synthetic construct
  REGION 1..19: note = icrucumab heavy chain CDR3
ARDHYGSGVHHYFYYGLDV

SEQ ID NO: 6301 - protein, 108 aa, synthetic construct
  REGION 1..108: note = icrucumab light chain V region
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 6302 - protein, 7 aa, synthetic construct
  REGION 1..7: note = icrucumab light chain CDR1
QSVSSSY

SEQ ID NO: 6303 - skipped

SEQ ID NO: 6304 - protein, 9 aa, synthetic construct
  REGION 1..9: note = icrucumab light chain CDR3
QQYGSSPLT

SEQ ID NO: 6305 - protein, 121 aa, synthetic construct
  REGION 1..121: note = idactamab heavy chain V region
QVQLQQWGAGLLKPSETLSLTCAVYGGSFSGYYWSWIRQPPGKGLEWIGEIHHSGGANYNPSLKSRVTISVDTSKNQFSLKLSSVTAADTAVYYCARGQGKNWHYDYFDYWGQGTLVTVSS

SEQ ID NO: 6306 - protein, 8 aa, synthetic construct
  REGION 1..8: note = idactamab heavy chain CDR1
GGSFSGYY

SEQ ID NO: 6307 - protein, 7 aa, synthetic construct
  REGION 1..7: note = idactamab heavy chain CDR2
IHHSGGA

SEQ ID NO: 6308 - protein, 15 aa, synthetic construct
  REGION 1..15: note = idactamab heavy chain CDR3
ARGQGKNWHYDYFDY

SEQ ID NO: 6309 - protein, 107 aa, synthetic construct
  REGION 1..107: note = idactamab light chain V region
DIQMTQSPSTLSASVGDRVTITCRASQSIRSWLAWYQQKPGKAPKLLIYKASILKIGVPSRFSGSGSGTEFTLTISSLQPDDFATYYCQQYYSYSRTFGQGTKVEIK

SEQ ID NO: 6310 - protein, 6 aa, synthetic construct
  REGION 1..6: note = idactamab light chain CDR1
QSIRSW

SEQ ID NO: 6311 - skipped

SEQ ID NO: 6312 - protein, 10 aa, synthetic construct
  REGION 1..10: note = idactamab light chain CDR3
QQYYSYSRTF

SEQ ID NO: 6313 - protein, 118 aa, synthetic construct
  REGION 1..118: note = ifabotuzumab heavy chain V region
QVQLVQSGAEVKKPGASVKVSCKASGYTFTGYWMNWVRQAPGQGLEWMGDIYPGSGNTNYDEKFQGRVTMTRDTSISTAYMELSRLRSDDTAVYYCARGGYYEDFDSWGQGTTVTVSS

SEQ ID NO: 6314 - protein, 8 aa, synthetic construct
  REGION 1..8: note = ifabotuzumab heavy chain CDR1
GYTFTGYW

SEQ ID NO: 6315 - protein, 8 aa, synthetic construct
  REGION 1..8: note = ifabotuzumab heavy chain CDR2
IYPGSGNT

SEQ ID NO: 6316 - protein, 11 aa, synthetic construct
  REGION 1..11: note = ifabotuzumab heavy chain CDR3
ARGGYYEDFDS

SEQ ID NO: 6317 - protein, 107 aa, synthetic construct
  REGION 1..107: note = ifabotuzumab light chain V region
DIQMTQSPSFLSASVGDRVTITCRASQGIISYLAWYQQKPEKAPKRLIYAASSLQSGVPSRFSGSGSGTEFTLTISSLQPEDFATYYCGQYANYPYTFGQGTKLEIK

SEQ ID NO: 6318 - protein, 6 aa, synthetic construct
  REGION 1..6: note = ifabotuzumab light chain CDR1
QGIISY

SEQ ID NO: 6319 - skipped

SEQ ID NO: 6320 - protein, 9 aa, synthetic construct
  REGION 1..9: note = ifabotuzumab light chain CDR3
GQYANYPYT

SEQ ID NO: 6321 - protein, 118 aa, synthetic construct
  REGION 1..118: note = imalumab heavy chain V region
EVQLLESGGGLVQPGGSLRLSCAASGFTFSIYSMNWVRQAPGKGLEWVSSIGSSGGTTYYADSVKGRFTISRDNSKNTLYLQMNSLRAEDTAVYYCAGSQWLYGMDVWGQGTTVTVSS

SEQ ID NO: 6322 - protein, 8 aa, synthetic construct
  REGION 1..8: note = imalumab heavy chain CDR1
GFTFSIYS

SEQ ID NO: 6323 - protein, 8 aa, synthetic construct
  REGION 1..8: note = imalumab heavy chain CDR2
IGSSGGTT

SEQ ID NO: 6324 - protein, 11 aa, synthetic construct
  REGION 1..11: note = imalumab heavy chain CDR3
AGSQWLYGMDV

SEQ ID NO: 6325 - protein, 107 aa, synthetic construct
  REGION 1..107: note = imalumab light chain V region
DIQMTQSPSSLSASVGDRVTITCRSSQRIMTYLNWYQQKPGKAPKLLIFVASHSQSGVPSRFRGSGSETDFTLTISGLQPEDSATYYCQQSFWTPLTFGGGTKVEIK

SEQ ID NO: 6326 - protein, 6 aa, synthetic construct
  REGION 1..6: note = imalumab light chain CDR1
QRIMTY

SEQ ID NO: 6327 - skipped

SEQ ID NO: 6328 - protein, 9 aa, synthetic construct
  REGION 1..9: note = imalumab light chain CDR3
QQSFWTPLT

SEQ ID NO: 6329 - protein, 120 aa, synthetic construct; identical to SEQ ID NO: 422
  REGION 1..120: note = imdevimab heavy chain V region

SEQ ID NO: 6330 - protein, 7 aa, synthetic construct
  REGION 1..7: note = imdevimab heavy chain CDR1
GFTFSNY

SEQ ID NO: 6331 - protein, 8 aa, synthetic construct
  REGION 1..8: note = imdevimab heavy chain CDR2
ISYDGSNK

SEQ ID NO: 6332 - protein, 12 aa, synthetic construct
  REGION 1..12: note = imdevimab heavy chain CDR3
SGSDYGDYLLVY

SEQ ID NO: 6333 - protein, 110 aa, synthetic construct; identical to SEQ ID NO: 421
  REGION 1..110: note = imdevimab light chain V region

SEQ ID NO: 6334 - protein, 9 aa, synthetic construct
  REGION 1..9: note = imdevimab light chain CDR1
SSDVGGYNY

SEQ ID NO: 6335 - skipped

SEQ ID NO: 6336 - protein, 10 aa, synthetic construct
  REGION 1..10: note = imdevimab light chain CDR3
NSLTSISTWV

SEQ ID NO: 6337 - protein, 124 aa, synthetic construct
  REGION 1..124: note = inclacumab heavy chain V region
EVQLVESGGGLVRPGGSLRLSCAASGFTFSNYDMHWVRQATGKGLEWVSAITAAGDIYYPGSVKGRFTISRENAKNSLYLQMNSLRAGDTAVYYCARGRYSGSGSYYNDWFDPWGQGTLVTVSS

SEQ ID NO: 6338 - protein, 7 aa, synthetic construct
  REGION 1..7: note = inclacumab heavy chain CDR1
GFTFSNY

SEQ ID NO: 6339 - protein, 7 aa, synthetic construct
  REGION 1..7: note = inclacumab heavy chain CDR2
ITAAGDI

SEQ ID NO: 6340 - protein, 18 aa, synthetic construct
  REGION 1..18: note = inclacumab heavy chain CDR3
ARGRYSGSGSYYNDWFDP

SEQ ID NO: 6341 - protein, 107 aa, synthetic construct
  REGION 1..107: note = inclacumab light chain V region
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIK

SEQ ID NO: 6342 - protein, 6 aa, synthetic construct
  REGION 1..6: note = inclacumab light chain CDR1
QSVSSY

SEQ ID NO: 6343 - skipped

SEQ ID NO: 6344 - protein, 9 aa, synthetic construct
  REGION 1..9: note = inclacumab light chain CDR3
QQRSNWPLT

SEQ ID NO: 6345 - protein, 119 aa, synthetic construct
  REGION 1..119: note = indusatumab heavy chain V region
QVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSS

SEQ ID NO: 6346 - protein, 8 aa, synthetic construct
  REGION 1..8: note = indusatumab heavy chain CDR1
GGSFSGYY

SEQ ID NO: 6347 - protein, 7 aa, synthetic construct
  REGION 1..7: note = indusatumab heavy chain CDR2
INHRGNT

SEQ ID NO: 6348 - protein, 13 aa, synthetic construct
  REGION 1..13: note = indusatumab heavy chain CDR3
ARERGYTYGNFDH

SEQ ID NO: 6349 - protein, 107 aa, synthetic construct
  REGION 1..107: note = indusatumab light chain V region
EIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIK

SEQ ID NO: 6350 - protein, 6 aa, synthetic construct
  REGION 1..6: note = indusatumab light chain CDR1
QSVSRN

SEQ ID NO: 6351 - skipped

SEQ ID NO: 6352 - protein, 9 aa, synthetic construct
  REGION 1..9: note = indusatumab light chain CDR3
QQYKTWPRT

SEQ ID NO: 6353 - protein, 119 aa, synthetic construct; identical to SEQ ID NO: 6345
  REGION 1..119: note = indusatumab vedotin heavy chain V region

SEQ ID NO: 6354 - protein, 8 aa, synthetic construct
  REGION 1..8: note = indusatumab vedotin heavy chain CDR1
GGSFSGYY

SEQ ID NO: 6355 - protein, 7 aa, synthetic construct
  REGION 1..7: note = indusatumab vedotin heavy chain CDR2
INHRGNT

SEQ ID NO: 6356 - protein, 13 aa, synthetic construct
  REGION 1..13: note = indusatumab vedotin heavy chain CDR3
ARERGYTYGNFDH

SEQ ID NO: 6357 - protein, 107 aa, synthetic construct; identical to SEQ ID NO: 6349
  REGION 1..107: note = indusatumab vedotin light chain V region

SEQ ID NO: 6358 - protein, 6 aa, synthetic construct
  REGION 1..6: note = indusatumab vedotin light chain CDR1
QSVSRN

SEQ ID NO: 6359 - skipped

SEQ ID NO: 6360 - protein, 9 aa, synthetic construct
  REGION 1..9: note = indusatumab vedotin light chain CDR3
QQYKTWPRT

SEQ ID NO: 6361 - protein, 121 aa, synthetic construct
  REGION 1..121: note = inebilizumab heavy chain V region
EVQLVESGGGLVQPGGSLRLSCAASGFTFSSSWMNWVRQAPGKGLEWVGRIYPGDGDTNYNVKFKGRFTISRDDSKNSLYLQMNSLKTEDTAVYYCARSGFITTVRDFDYWGQGTLVTVSS

SEQ ID NO: 6362 - protein, 8 aa, synthetic construct
  REGION 1..8: note = inebilizumab heavy chain CDR1
GFTFSSSW

SEQ ID NO: 6363 - protein, 8 aa, synthetic construct
  REGION 1..8: note = inebilizumab heavy chain CDR2
IYPGDGDT

SEQ ID NO: 6364 - protein, 14 aa, synthetic construct
  REGION 1..14: note = inebilizumab heavy chain CDR3
ARSGFITTVRDFDY

SEQ ID NO: 6365 - protein, 111 aa, synthetic construct
  REGION 1..111: note = inebilizumab light chain V region
EIVLTQSPDFQSVTPKEKVTITCRASESVDTFGISFMNWFQQKPDQSPKLLIHEASNQGSGVPSRFSGSGSGTDFTLTINSLEAEDAATYYCQQSKEVPFTFGGGTKVEIK

SEQ ID NO: 6366 - protein, 10 aa, synthetic construct
  REGION 1..10: note = inebilizumab light chain CDR1
ESVDTFGISF

SEQ ID NO: 6367 - skipped

SEQ ID NO: 6368 - protein, 10 aa, synthetic construct
  REGION 1..10: note = inebilizumab light chain CDR3
QQSKEVPFTF

SEQ ID NO: 6369 - protein, 119 aa, synthetic construct
  REGION 1..119: note = infliximab heavy chain V region
EVKLEESGGGLVQPGGSMKLSCVASGFIFSNHWMNWVRQSPEKGLEWVAEIRSKSINSATHYAESVKGRFTISRDDSKSAVYLQMTDLRTEDTGVYYCSRNYYGSTYDYWGQGTTLTVS

SEQ ID NO: 6370 - protein, 7 aa, synthetic construct
  REGION 1..7: note = infliximab heavy chain CDR1
GFIFSNH

SEQ ID NO: 6371 - protein, 10 aa, synthetic construct
  REGION 1..10: note = infliximab heavy chain CDR2
IRSKSINSAT

SEQ ID NO: 6372 - protein, 11 aa, synthetic construct
  REGION 1..11: note = infliximab heavy chain CDR3
SRNYYGSTYDY

SEQ ID NO: 6373 - protein, 107 aa, synthetic construct
  REGION 1..107: note = infliximab light chain V region
DILLTQSPAILSVSPGERVSFSCRASQFVGSSIHWYQQRTNGSPRLLIKYASESMSGIPSRFSGSGSGTDFTLSINTVESEDIADYYCQQSHSWPFTFGSGTNLEVK

SEQ ID NO: 6374 - protein, 6 aa, synthetic construct
  REGION 1..6: note = infliximab light chain CDR1
QFVGSS

SEQ ID NO: 6375 - skipped

SEQ ID NO: 6376 - protein, 9 aa, synthetic construct
  REGION 1..9: note = infliximab light chain CDR3
QQSHSWPFT

SEQ ID NO: 6377 - protein, 119 aa, synthetic construct
  REGION 1..119: note = intetumumab heavy chain V region
QVQLVESGGGVVQPGRSRRLSCAASGFTFSRYTMHWVRQAPGKGLEWVAVISFDGSNKYYVDSVKGRFTISRDNSENTLYLQVNILRAEDTAVYYCAREARGSYAFDIWGQGTMVTVSS

SEQ ID NO: 6378 - protein, 8 aa, synthetic construct
  REGION 1..8: note = intetumumab heavy chain CDR1
GFTFSRYT

SEQ ID NO: 6379 - protein, 8 aa, synthetic construct
  REGION 1..8: note = intetumumab heavy chain CDR2
ISFDGSNK

SEQ ID NO: 6380 - protein, 12 aa, synthetic construct
  REGION 1..12: note = intetumumab heavy chain CDR3
AREARGSYAFDI

SEQ ID NO: 6381 - protein, 108 aa, synthetic construct
  REGION 1..108: note = intetumumab light chain V region
EIVLTQSPATLSLSPGERATLSCRASQSVSSYLAWYQQKPGQAPRLLIYDASNRATGIPARFSGSGSGTDFTLTISSLEPEDFAVYYCQQRSNWPPFTFGPGTKVDIK

SEQ ID NO: 6382 - protein, 6 aa, synthetic construct
  REGION 1..6: note = intetumumab light chain CDR1
QSVSSY

SEQ ID NO: 6383 - skipped

SEQ ID NO: 6384 - protein, 10 aa, synthetic construct
  REGION 1..10: note = intetumumab light chain CDR3
QQRSNWPPFT

SEQ ID NO: 6385 - protein, 118 aa, synthetic construct
  REGION 1..118: note = ipilimumab heavy chain V region
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 6386 - protein, 7 aa, synthetic construct
  REGION 1..7: note = ipilimumab heavy chain CDR1
GFTFSSY

SEQ ID NO: 6387 - protein, 8 aa, synthetic construct
  REGION 1..8: note = ipilimumab heavy chain CDR2
ISYDGNNK

SEQ ID NO: 6388 - protein, 11 aa, synthetic construct
  REGION 1..11: note = ipilimumab heavy chain CDR3
ARTGWLGPFDY

SEQ ID NO: 6389 - protein, 108 aa, synthetic construct
  REGION 1..108: note = ipilimumab light chain V region
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 6390 - protein, 7 aa, synthetic construct
  REGION 1..7: note = ipilimumab light chain CDR1
QSVGSSY

SEQ ID NO: 6391 - skipped

SEQ ID NO: 6392 - protein, 9 aa, synthetic construct
  REGION 1..9: note = ipilimumab light chain CDR3
QQYGSSPWT

SEQ ID NO: 6393 - protein, 112 aa, synthetic construct
  REGION 1..112: note = iratumumab heavy chain V region
QVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSS

SEQ ID NO: 6394 - protein, 8 aa, synthetic construct
  REGION 1..8: note = iratumumab heavy chain CDR1
GGSFSAYY

SEQ ID NO: 6395 - protein, 10 aa, synthetic construct
  REGION 1..10: note = iratumumab heavy chain CDR2
IGDINHGGGT

SEQ ID NO: 6396 - protein, 6 aa, synthetic construct
  REGION 1..6: note = iratumumab heavy chain CDR3
ASLTAY

SEQ ID NO: 6397 - protein, 107 aa, synthetic construct
  REGION 1..107: note = iratumumab light chain V region
DIQMTQSPTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIK

SEQ ID NO: 6398 - protein, 6 aa, synthetic construct
  REGION 1..6: note = iratumumab light chain CDR1
QGISSW

SEQ ID NO: 6399 - skipped

SEQ ID NO: 6400 - protein, 9 aa, synthetic construct
  REGION 1..9: note = iratumumab light chain CDR3
QQYDSYPIT

SEQ ID NO: 6401 - protein, 120 aa, synthetic construct [sequence omitted]

SEQ ID NO: 6402 - protein, 8 aa, synthetic construct
  REGION 1..8: note = isatuximab heavy chain CDR1
GYTFTDYW

SEQ ID NO: 6403 - protein, 8 aa, synthetic construct
  REGION 1..8: note = isatuximab heavy chain CDR2
IYPGDGDT

SEQ ID NO: 6404 - protein, 13 aa, synthetic construct
  REGION 1..13: note = isatuximab heavy chain CDR3
ARGDYYGSNSLDY

SEQ ID NO: 6405 - protein, 107 aa, synthetic construct [sequence omitted]

SEQ ID NO: 6406 - protein, 6 aa, synthetic construct
  REGION 1..6: note = isatuximab light chain CDR1
QDVSTV

SEQ ID NO: 6407 - skipped

SEQ ID NO: 6408 - protein, 9 aa, synthetic construct
  REGION 1..9: note = isatuximab light chain CDR3
QQHYSPPYT

SEQ ID NO: 6409 - protein, 120 aa, synthetic construct
  REGION 1..120: note = iscalimab heavy chain V region
QVQLVESGGGVVQPGRSLRLSCAASGFTFSSYGMHWVRQAPGKGLEWVAVISYEESNRYHADSVKGRFTISRDNSKITLYLQMNSLRTEDTAVYYCARDGGIAAPGPDYWGQGTLVTVSS

SEQ ID NO: 6410 - protein, 7 aa, synthetic construct
  REGION 1..7: note = iscalimab heavy chain CDR1
GFTFSSY

SEQ ID NO: 6411 - protein, 8 aa, synthetic construct
  REGION 1..8: note = iscalimab heavy chain CDR2
ISYEESNR

SEQ ID NO: 6412 - protein, 13 aa, synthetic construct
  REGION 1..13: note = iscalimab heavy chain CDR3
ARDGGIAAPGPDY

SEQ ID NO: 6413 - protein, 112 aa, synthetic construct
  REGION 1..112: note = iscalimab light chain V region
DIVMTQSPLSLTVTPGEPASISCRSSQSLLYSNGYNYLDWYLQKPGQSPQVLISLGSNRASGVPDRFSGSGSGTDFTLKISRVEAEDVGVYYCMQARQTPFTFGPGTKVDIR

SEQ ID NO: 6414 - protein, 11 aa, synthetic construct
  REGION 1..11: note = iscalimab light chain CDR1
QSLLYSNGYNY

SEQ ID NO: 6415 - skipped

SEQ ID NO: 6416 - protein, 9 aa, synthetic construct
  REGION 1..9: note = iscalimab light chain CDR3
MQARQTPFT

SEQ ID NO: 6417 - protein, 122 aa, synthetic construct
  REGION 1..122: note = itepekimab heavy chain V region
EVQLVESGGNLEQPGGSLRLSCTASGFTFSRSAMNWVRRAPGKGLEWVSGISGSGGRTYYADSVKGRFTISRDNSKNTLYLQMNSLSAEDTAAYYCAKDSYTTSWYGGMDVWGHGTTVTVSS

SEQ ID NO: 6418 - protein, 8 aa, synthetic construct
  REGION 1..8: note = itepekimab heavy chain CDR1
GFTFSRSA

SEQ ID NO: 6419 - protein, 8 aa, synthetic construct
  REGION 1..8: note = itepekimab heavy chain CDR2
ISGSGGRT

SEQ ID NO: 6420 - protein, 15 aa, synthetic construct
  REGION 1..15: note = itepekimab heavy chain CDR3
AKDSYTTSWYGGMDV

SEQ ID NO: 6421 - protein, 107 aa, synthetic construct
  REGION 1..107: note = itepekimab light chain V region
DIQMTQSPSSVSASVGDRVTITCRASQGIFSWLAWYQQKPGKAPKLLIYAASSLQSGVPSRFSGSGSGTDFTLTISSLQPEDFAIYYCQQANSVPITFGQGTRLEIK

SEQ ID NO: 6422 - protein, 6 aa, synthetic construct
  REGION 1..6: note = itepekimab light chain CDR1
QGIFSW

SEQ ID NO: 6423 - skipped

SEQ ID NO: 6424 - protein, 9 aa, synthetic construct
  REGION 1..9: note = itepekimab light chain CDR3
QQANSVPIT

SEQ ID NO: 6425 - protein, 119 aa, synthetic construct
  REGION 1..119: note = itolizumab heavy chain V region
EVQLVESGGGLVKPGGSLKLSCAASGFKFSRYAMSWVRQAPGKRLEWVATISSGGSYIYYPDSVKGRFTISRDNVKNTLYLQMSSLRSEDTAMYYCARRDYDLDYFDSWGQGTLVTVSS

SEQ ID NO: 6426 - protein, 8 aa, synthetic construct
  REGION 1..8: note = itolizumab heavy chain CDR1
GFKFSRYA

SEQ ID NO: 6427 - protein, 7 aa, synthetic construct
  REGION 1..7: note = itolizumab heavy chain CDR2
ISSGGSY

SEQ ID NO: 6428 - protein, 12 aa, synthetic construct
  REGION 1..12: note = itolizumab heavy chain CDR3
ARRDYDLDYFDS

SEQ ID NO: 6429 - protein, 107 aa, synthetic construct
  REGION 1..107: note = itolizumab light chain V region
DIQMTQSPSSLSASVGDRVTITCKASRDIRSYLTWYQQKPGKAPKTLIYYATSLADGVPSRFSGSGSGQDYSLTISSLESDDTATYYCLQHGESPFTLGSGTKLEIK

SEQ ID NO: 6430 - protein, 7 aa, synthetic construct
  REGION 1..7: note = itolizumab light chain CDR1
RDIRSYL

SEQ ID NO: 6431 - skipped

SEQ ID NO: 6432 - protein, 13 aa, synthetic construct
  REGION 1..13: note = itolizumab light chain CDR3
LQHGESPFTLGSG

SEQ ID NO: 6433 - protein, 118 aa, synthetic construct
  REGION 1..118: note = ivuxolimab heavy chain V region
EVQLVESGGGLVQPGGSLRLSCAASGFTFSSYSMNWVRQAPGKGLEWVSYISSSSSTIDYADSVKGRFTISRDNAKNSLYLQMNSLRDEDTAVYYCARESGWYLFDYWGQGTLVTVSS

SEQ ID NO: 6434 - protein, 8 aa, synthetic construct
  REGION 1..8: note = ivuxolimab heavy chain CDR1
GFTFSSYS

SEQ ID NO: 6435 - protein, 8 aa, synthetic construct
  REGION 1..8: note = ivuxolimab heavy chain CDR2
ISSSSSTI

SEQ ID NO: 6436 - protein, 11 aa, synthetic construct
  REGION 1..11: note = ivuxolimab heavy chain CDR3
ARESGWYLFDY

SEQ ID NO: 6437 - protein, 107 aa, synthetic construct
  REGION 1..107: note = ivuxolimab light chain V region
DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIK

SEQ ID NO: 6438 - protein, 6 aa, synthetic construct
  REGION 1..6: note = ivuxolimab light chain CDR1
QGISSW

SEQ ID NO: 6439 - skipped

SEQ ID NO: 6440 - protein, 9 aa, synthetic construct
  REGION 1..9: note = ivuxolimab light chain CDR3
QQYNSYPPT

SEQ ID NO: 6441 - protein, 119 aa, synthetic construct
  REGION 1..119: note = ixekizumab heavy chain V region
QVQLVQSGAEVKKPGSSVKVSCKASGYSFTDYHIHWVRQAPGQGLEWMGVINPMYGTTDYNQRFKGRVTITADESTSTAYMELSSLRSEDTAVYYCARYDYFTGTGVYWGQGTLVTVSS

SEQ ID NO: 6442 - protein, 8 aa, synthetic construct
  REGION 1..8: note = ixekizumab heavy chain CDR1
GYSFTDYH

SEQ ID NO: 6443 - protein, 8 aa, synthetic construct
  REGION 1..8: note = ixekizumab heavy chain CDR2
INPMYGTT

SEQ ID NO: 6444 - protein, 12 aa, synthetic construct
  REGION 1..12: note = ixekizumab heavy chain CDR3
ARYDYFTGTGVY

SEQ ID NO: 6445 - protein, 112 aa, synthetic construct
  REGION 1..112: note = ixekizumab light chain V region
DIVMTQTPLSLSVTPGQPASISCRSSRSLVHSRGNTYLHWYLQKPGQSPQLLIYKVSNRFIGVPDRFSGSGSGTDFTLKISRVEAEDVGVYYCSQSTHLPFTFGQGTKLEIK

SEQ ID NO: 6446 - protein, 11 aa, synthetic construct
  REGION 1..11: note = ixekizumab light chain CDR1
RSLVHSRGNTY

SEQ ID NO: 6447 - skipped

SEQ ID NO: 6448 - protein, 9 aa, synthetic construct
  REGION 1..9: note = ixekizumab light chain CDR3
SQSTHLPFT

SEQ ID NO: 6449 - protein, 122 aa, synthetic construct
  REGION 1..122: note = lanadelumab heavy chain V region
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSS

SEQ ID NO: 6450 - protein, 8 aa, synthetic construct
  REGION 1..8: note = lanadelumab heavy chain CDR1
GFTFSHYI

SEQ ID NO: 6451 - protein, 8 aa, synthetic construct
  REGION 1..8: note = lanadelumab heavy chain CDR2
IYSSGGIT

SEQ ID NO: 6452 - protein, 15 aa, synthetic construct
  REGION 1..15: note = lanadelumab heavy chain CDR3
AYRRIGVPRRDEFDI

SEQ ID NO: 6453 - protein, 106 aa, synthetic construct
  REGION 1..106: note = lanadelumab light chain V region
DIQMTQSPSTLSASVGDRVTITCRASQSISSWLAWYQQKPGKAPKLLIYKASTLESGVPSRFSGSGSGTEFTLTISSLQPDDFATYYCQQYNTYWTFGQGTKVEIK

SEQ ID NO: 6454 - protein, 6 aa, synthetic construct
  REGION 1..6: note = lanadelumab light chain CDR1
QSISSW

SEQ ID NO: 6455 - skipped

SEQ ID NO: 6456 - protein, 8 aa, synthetic construct
  REGION 1..8: note = lanadelumab light chain CDR3
QQYNTYWT

SEQ ID NO: 6457 - protein, 122 aa, synthetic construct
  REGION 1..122: note = latozinemab heavy chain V region
QVQLQESGPGLVKPSETLSLTCAVSGYSISSGYYWGWIRQPPGKGLEWIGTIYHSGSTYYNPSLKSRVTISVDTSKNQFSLKLSSVTAADTAVYYCARQGSIKQGYYGMDVWGQGTTVTVSS

SEQ ID NO: 6458 - protein, 9 aa, synthetic construct
  REGION 1..9: note = latozinemab heavy chain CDR1
GYSISSGYY

SEQ ID NO: 6459 - protein, 7 aa, synthetic construct
  REGION 1..7: note = latozinemab heavy chain CDR2
IYHSGST

SEQ ID NO: 6460 - protein, 15 aa, synthetic construct
  REGION 1..15: note = latozinemab heavy chain CDR3
ARQGSIKQGYYGMDV

SEQ ID NO: 6461 - protein, 112 aa, synthetic construct
  REGION 1..112: note = latozinemab light chain V region
DIVMTQSPLSLPVTPGEPASISCRSSQSLLRSTGYNYLDWYLQKPGQSPQLLIYLGSNRASGVPDRFSGSGSGTDFTLKISRAEAEDVGVYYCMQQQEAPLTFGGGTKVEIK

SEQ ID NO: 6462 - protein, 12 aa, synthetic construct
  REGION 1..12: note = latozinemab light chain CDR1
QSLLRSTGYNYL

SEQ ID NO: 6463 - skipped

SEQ ID NO: 6464 - protein, 9 aa, synthetic construct
  REGION 1..9: note = latozinemab light chain CDR3
MQQQEAPLT

SEQ ID NO: 6465 - protein, 118 aa, synthetic construct
  REGION 1..118: note = lemzoparlimab heavy chain V region
EVQLVESGGGLVKPGGSLRLSCAASGLTFERAWMNWVRQAPGKGLEWVGRIKRKTDGETTDYAAPVKGRFSISRDDSKNTLYLQMNSLKTEDTAVYYCAGSNRAFDIWGQGTMVTVSS

SEQ ID NO: 6466 - protein, 8 aa, synthetic construct
  REGION 1..8: note = lemzoparlimab heavy chain CDR1
GLTFERAW

SEQ ID NO: 6467 - protein, 10 aa, synthetic construct
  REGION 1..10: note = lemzoparlimab heavy chain CDR2
IKRKTDGETT

SEQ ID NO: 6468 - protein, 9 aa, synthetic construct
  REGION 1..9: note = lemzoparlimab heavy chain CDR3
AGSNRAFDI

SEQ ID NO: 6469 - protein, 113 aa, synthetic construct
  REGION 1..113: note = lemzoparlimab light chain V region
DIVMTQSPDSLAVSLGERATINCKSSQSVLYAGNNRNYLAWYQQKPGQPPKLLINQASTRASGVPDRFSGSGSGTEFTLIISSLQAEDVAIYYCQQYYTPPLAFGGGTKLEIK

SEQ ID NO: 6470 - protein, 12 aa, synthetic construct
  REGION 1..12: note = lemzoparlimab light chain CDR1
QSVLYAGNNRNY

SEQ ID NO: 6471 - skipped

SEQ ID NO: 6472 - protein, 9 aa, synthetic construct
  REGION 1..9: note = lemzoparlimab light chain CDR3
QQYYTPPLA

SEQ ID NO: 6473 - protein, 119 aa, synthetic construct [sequence omitted]

SEQ ID NO: 6474 - protein, 9 aa, synthetic construct
  REGION 1..9: note = lenzilumab heavy chain CDR1
GYSFTNYYI

SEQ ID NO: 6475 - protein, 8 aa, synthetic construct
  REGION 1..8: note = lenzilumab heavy chain CDR2
INAGNGNT

SEQ ID NO: 6476 - protein, 12 aa, synthetic construct
  REGION 1..12: note = lenzilumab heavy chain CDR3
VRRQRFPYYFDY

SEQ ID NO: 6477 - protein, 107 aa, synthetic construct [sequence omitted]

SEQ ID NO: 6478 - protein, 6 aa, synthetic construct
  REGION 1..6: note = lenzilumab light chain CDR1
QSVGTN

SEQ ID NO: 6479 - skipped

SEQ ID NO: 6480 - protein, 9 aa, synthetic construct
  REGION 1..9: note = lenzilumab light chain CDR3
QQFNKSPLT

SEQ ID NO: 6481 - protein, 123 aa, synthetic construct
  REGION 1..123: note = lesofavumab heavy chain V region
EVQLVQSGAEVKKPGESLKISCKVSGYSFTSQWIGWVRQMPGKGLEWIGMMYPGESETIYSPSFQGQVTISADNSISTAYLQWSSLKASDTAIYYCASGPGYSGYHYGWFDTWGQGTLVTVSS

SEQ ID NO: 6482 - protein, 8 aa, synthetic construct
  REGION 1..8: note = lesofavumab heavy chain CDR1
GYSFTSQW

SEQ ID NO: 6483 - protein, 8 aa, synthetic construct
  REGION 1..8: note = lesofavumab heavy chain CDR2
MYPGESET

SEQ ID NO: 6484 - protein, 16 aa, synthetic construct
  REGION 1..16: note = lesofavumab heavy chain CDR3
ASGPGYSGYHYGWFDT

SEQ ID NO: 6485 - protein, 112 aa, synthetic construct
  REGION 1..112: note = lesofavumab light chain V region
DIVMTQSPLSLPVTPGEPASISCRSSQSLLRSNGYNYLDWYLQKPGQSPQLLIYLGSNRASGVPDRFSGSGSGTDFTLKISRVEAEDVGVYYCMQALQTPYTFGQGTKLEIK

SEQ ID NO: 6486 - protein, 11 aa, synthetic construct
  REGION 1..11: note = lesofavumab light chain CDR1
QSLLRSNGYNY

SEQ ID NO: 6487 - skipped

SEQ ID NO: 6488 - protein, 9 aa, synthetic construct
  REGION 1..9: note = lesofavumab light chain CDR3
MQALQTPYT

SEQ ID NO: 6489 - protein, 115 aa, synthetic construct
  REGION 1..115: note = letaplimab heavy chain V region
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARGKTGSAAWGQGTLVTVSS

SEQ ID NO: 6490 - protein, 8 aa, synthetic construct
  REGION 1..8: note = letaplimab heavy chain CDR1
GGSISSYY

SEQ ID NO: 6491 - protein, 8 aa, synthetic construct
  REGION 1..8: note = letaplimab heavy chain CDR2
IYYSGSTN

SEQ ID NO: 6492 - protein, 9 aa, synthetic construct
  REGION 1..9: note = letaplimab heavy chain CDR3
ARGKTGSAA

SEQ ID NO: 6493 - protein, 107 aa, synthetic construct
  REGION 1..107: note = letaplimab light chain V region
DIQMTQSPSSVSASVGDRVTITCRASQGISRWLAWYQQKPGKAPKLLIYAASSLQSGVPSRFSGSGSGTDFTLTISSLQPEDFATYYCQQTVSFPITFGGGTKVEIK

SEQ ID NO: 6494 - protein, 6 aa, synthetic construct
  REGION 1..6: note = letaplimab light chain CDR1
QGISRW

SEQ ID NO: 6495 - skipped

SEQ ID NO: 6496 - protein, 9 aa, synthetic construct
  REGION 1..9: note = letaplimab light chain CDR3
QQTVSFPIT

SEQ ID NO: 6497 - protein, 121 aa, synthetic construct
  REGION 1..121: note = lexatumumab heavy chain V region
EVQLVQSGGGVERPGGSLRLSCAASGFTFDDYGMSWVRQAPGKGLEWVSGINWNGGSTGYADSVKGRVTISRDNAKNSLYLQMNSLRAEDTAVYYCAKILGAGRGWYFDLWGKGTTVTVSS

SEQ ID NO: 6498 - protein, 8 aa, synthetic construct
  REGION 1..8: note = lexatumumab heavy chain CDR1
GFTFDDYG

SEQ ID NO: 6499 - protein, 8 aa, synthetic construct
  REGION 1..8: note = lexatumumab heavy chain CDR2
INWNGGST

SEQ ID NO: 6500 - protein, 14 aa, synthetic construct
  REGION 1..14: note = lexatumumab heavy chain CDR3
AKILGAGRGWYFDL

SEQ ID NO: 6501 - protein, 108 aa, synthetic construct
  REGION 1..108: note = lexatumumab light chain V region
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVL

SEQ ID NO: 6502 - protein, 9 aa, synthetic construct
  REGION 1..9: note = lexatumumab light chain CDR1
QGDSLRSYY

SEQ ID NO: 6503 - skipped

SEQ ID NO: 6504 - protein, 11 aa, synthetic construct
  REGION 1..11: note = lexatumumab light chain CDR3
NSRDSSGNHVV

SEQ ID NO: 6505 - protein, 116 aa, synthetic construct
  REGION 1..116: note = lintuzumab satetraxetan heavy chain V region
QVQLVQSGAEVKKPGSSVKVSCKASGYTFTDYNMHWVRQAPGQGLEWIGYIYPYNGGTGYNQKFKSKATITADESTNTAYMELSSLRSEDTAVYYCARGRPAMDYWGQGTLVTVSS

SEQ ID NO: 6506 - protein, 8 aa, synthetic construct
  REGION 1..8: note = lintuzumab satetraxetan heavy chain CDR1
GYTFTDYN

SEQ ID NO: 6507 - protein, 8 aa, synthetic construct
  REGION 1..8: note = lintuzumab satetraxetan heavy chain CDR2
IYPYNGGT

SEQ ID NO: 6508 - protein, 9 aa, synthetic construct
  REGION 1..9: note = lintuzumab satetraxetan heavy chain CDR3
ARGRPAMDY

SEQ ID NO: 6509 - protein, 111 aa, synthetic construct
  REGION 1..111: note = lintuzumab satetraxetan light chain V region
DIQMTQSPSSLSASVGDRVTITCRASESVDNYGISFMNWFQQKPGKAPKLLIYAASNQGSGVPSRFSGSGSGTDFTLTISSLQPDDFATYYCQQSKEVPWTFGQGTKVEIK

SEQ ID NO: 6510 - protein, 10 aa, synthetic construct
  REGION 1..10: note = lintuzumab satetraxetan light chain CDR1
ESVDNYGISF

SEQ ID NO: 6511 - skipped

SEQ ID NO: 6512 - protein, 9 aa, synthetic construct
  REGION 1..9: note = lintuzumab satetraxetan light chain CDR3
QQSKEVPWT

SEQ ID NO: 6513 - protein, 123 aa, synthetic construct
  REGION 1..123: note = lirilumab heavy chain V region
QVQLVQSGAEVKKPGSSVKVSCKASGGTFSFYAISWVRQAPGQGLEWMGGFIPIFGAANYAQKFQGRVTITADESTSTAYMELSSLRSDDTAVYYCARIPSGSYYYDYDMDVWGQGTTVTVSS

SEQ ID NO: 6514 - protein, 8 aa, synthetic construct
  REGION 1..8: note = lirilumab heavy chain CDR1
GGTFSFYA

SEQ ID NO: 6515 - protein, 7 aa, synthetic construct
  REGION 1..7: note = lirilumab heavy chain CDR2
IPIFGAA

SEQ ID NO: 6516 - protein, 16 aa, synthetic construct
  REGION 1..16: note = lirilumab heavy chain CDR3
ARIPSGSYYYDYDMDV

SEQ ID NO: 6517 - protein, 107 aa, synthetic construct
  REGION 1..107: note = lirilumab light chain V region
EIVLTQSPVTLSLSPGERATLSCRASQSVSSYLAWYQQKPGQAPRLLIYDASNRATGIPARFSGSGSGTDFTLTISSLEPEDFAVYYCQQRSNWMYTFGQGTKLEIK

SEQ ID NO: 6518 - protein, 6 aa, synthetic construct
  REGION 1..6: note = lirilumab light chain CDR1
QSVSSY

SEQ ID NO: 6519 - skipped

SEQ ID NO: 6520 - protein, 9 aa, synthetic construct
  REGION 1..9: note = lirilumab light chain CDR3
QQRSNWMYT

SEQ ID NO: 6521 - protein, 123 aa, synthetic construct
  REGION 1..123: note = lodapolimab heavy chain V region
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSPDYSPYYYYGMDVWGQGTTVTVSS

SEQ ID NO: 6522 - protein, 7 aa, synthetic construct
  REGION 1..7: note = lodapolimab heavy chain CDR1
GGTFSSY

SEQ ID NO: 6523 - protein, 8 aa, synthetic construct
  REGION 1..8: note = lodapolimab heavy chain CDR2
IIPIFGTA

SEQ ID NO: 6524 - protein, 16 aa, synthetic construct
  REGION 1..16: note = lodapolimab heavy chain CDR3
ARSPDYSPYYYYGMDV

SEQ ID NO: 6525 - protein, 110 aa, synthetic construct
  REGION 1..110: note = lodapolimab light chain V region
QSVLTQPPSASGTPGQRVTISCSGSSSNIGSNTVNWYQQLPGTAPKLLIYGNSNRPSGVPDRFSGSKSGTSASLAISGLQSEDEADYYCQSYDSSLSGSVFGGGIKLTVL

SEQ ID NO: 6526 - protein, 9 aa, synthetic construct
  REGION 1..9: note = lodapolimab light chain CDR1
SSSNIGSNT

SEQ ID NO: 6527 - skipped

SEQ ID NO: 6528 - protein, 11 aa, synthetic construct
  REGION 1..11: note = lodapolimab light chain CDR3
QSYDSSLSGSV

SEQ ID NO: 6529 - protein, 118 aa, synthetic construct
  REGION 1..118: note = lokivetmab heavy chain V region
EVQLVESGGDLVKPGGSLRLSCVASGFTFSNYGMSWVRQAPGKGLQWVATISYGGSYTYYPDNIKGRFTISRDNAKNTLYLQMNSLRAEDTAMYYCVRGYGYDTMDYWGQGTLVTVSS

SEQ ID NO: 6530 - protein, 8 aa, synthetic construct
  REGION 1..8: note = lokivetmab heavy chain CDR1
GFTFSNYG

SEQ ID NO: 6531 - protein, 8 aa, synthetic construct
  REGION 1..8: note = lokivetmab heavy chain CDR2
ISYGGSYT

SEQ ID NO: 6532 - protein, 11 aa, synthetic construct
  REGION 1..11: note = lokivetmab heavy chain CDR3
VRGYGYDTMDY

SEQ ID NO: 6533 - protein, 111 aa, synthetic construct
  REGION 1..111: note = lokivetmab light chain V region
EIVMTQSPASLSLSQEEKVTITCKASQSVSFAGTGLMHWYQQKPGQAPKLLIYRASNLEAGVPSRFSGSGSGTDFSFTISSLEPEDVAVYYCQQSREYPWTFGQGTKLEIK

SEQ ID NO: 6534 - protein, 8 aa, synthetic construct
  REGION 1..8: note = lokivetmab light chain CDR1
QSVSFAGT

SEQ ID NO: 6535 - skipped

SEQ ID NO: 6536 - protein, 9 aa, synthetic construct
  REGION 1..9: note = lokivetmab light chain CDR3
QQSREYPWT

SEQ ID NO: 6537 - protein, 120 aa, synthetic construct
  REGION 1..120: note = lomtegovimab heavy chain V region
QVQLVESGGGVVQPGRSLRLSCAATGFTFRRYGMHWVRQAPGKGLEWVAGILFDGSNKYYVDSVKGRFTISRDSSRNTLYLQLNSLRREDTAVYYCAKGGDYEWELLESWGQGTLVTVSS

SEQ ID NO: 6538 - protein, 8 aa, synthetic construct
  REGION 1..8: note = lomtegovimab heavy chain CDR1
GFTFRRYG

SEQ ID NO: 6539 - protein, 8 aa, synthetic construct
  REGION 1..8: note = lomtegovimab heavy chain CDR2
ILFDGSNK

SEQ ID NO: 6540 - protein, 13 aa, synthetic construct
  REGION 1..13: note = lomtegovimab heavy chain CDR3
AKGGDYEWELLES

SEQ ID NO: 6541 - protein, 107 aa, synthetic construct
  REGION 1..107: note = lomtegovimab light chain V region
DIQMTQSPSTVSASVGDRVTITCRASQSIDNWLAWYQEKPGKAPKVLIYKASSLESGVPSRFSGRGSGTEFTLTISSLQPGDFATYYCQHYHSFPLTFGGGTKVDIK

SEQ ID NO: 6542 - protein, 6 aa, synthetic construct
  REGION 1..6: note = lomtegovimab light chain CDR1
QSIDNW

SEQ ID NO: 6543 - skipped

SEQ ID NO: 6544 - protein, 9 aa, synthetic construct
  REGION 1..9: note = lomtegovimab light chain CDR3
QHYHSFPLT

SEQ ID NO: 6545 - protein, 120 aa, synthetic construct
  REGION 1..120: note = loncastuximab tesirine heavy chain V region
QVQLVQPGAEVVKPGASVKLSCKTSGYTFTSNWMHWVKQAPGQGLEWIGEIDPSDSYTNYNQNFQGKAKLTVDKSTSTAYMEVSSLRSDDTAVYYCARGSNPYYYAMDYWGQGTSVTVSS

SEQ ID NO: 6546 - protein, 8 aa, synthetic construct
  REGION 1..8: note = loncastuximab tesirine heavy chain CDR1
GYTFTSNW

SEQ ID NO: 6547 - protein, 8 aa, synthetic construct
  REGION 1..8: note = loncastuximab tesirine heavy chain CDR2
IDPSDSYT

SEQ ID NO: 6548 - protein, 13 aa, synthetic construct
  REGION 1..13: note = loncastuximab tesirine heavy chain CDR3
ARGSNPYYYAMDY

SEQ ID NO: 6549 - protein, 109 aa, synthetic construct
  REGION 1..109: note = loncastuximab tesirine light chain V region
EIVLTQSPAIMSASPGERVTMTCSASSGVNYMHWYQQKPGTSPRRWIYDTSKLASGVPARSGVNYFSGSGSGTSYSLTISSMEPEDAATYYCHQRGSYTFGGGTKLEIK

SEQ ID NO: 6550 - protein, 5 aa, synthetic construct
  REGION 1..5: note = loncastuximab tesirine light chain CDR1
SGVNY

SEQ ID NO: 6551 - skipped

SEQ ID NO: 6552 - protein, 7 aa, synthetic construct
  REGION 1..7: note = loncastuximab tesirine light chain CDR3
HQRGSYT

SEQ ID NO: 6553 - protein, 120 aa, synthetic construct; identical to SEQ ID NO: 6409
  REGION 1..120: note = lucatumumab heavy chain V region

SEQ ID NO: 6554 - protein, 7 aa, synthetic construct
  REGION 1..7: note = lucatumumab heavy chain CDR1
GFTFSSY

SEQ ID NO: 6555 - protein, 8 aa, synthetic construct
  REGION 1..8: note = lucatumumab heavy chain CDR2
ISYEESNR

SEQ ID NO: 6556 - protein, 13 aa, synthetic construct
  REGION 1..13: note = lucatumumab heavy chain CDR3
ARDGGIAAPGPDY

SEQ ID NO: 6557 - protein, 112 aa, synthetic construct; identical to SEQ ID NO: 6413
  REGION 1..112: note = lucatumumab light chain V region

SEQ ID NO: 6558 - protein, 11 aa, synthetic construct
  REGION 1..11: note = lucatumumab light chain CDR1
QSLLYSNGYNY

SEQ ID NO: 6559 - skipped

SEQ ID NO: 6560 - protein, 9 aa, synthetic construct
  REGION 1..9: note = lucatumumab light chain CDR3
MQARQTPFT

SEQ ID NO: 6561 - protein, 117 aa, synthetic construct
  REGION 1..117: note = lupartumab heavy chain V region
EVQLLESGGGLVQPGGSLRLSCAASGFTFSNAWMSWVRQAPGKGLEWVSYISSSGSTIYYADSVKGRFTISRDNSKNTLYLQMNSLRAEDTAVYYCAREGLWAFDYWGQGTLVTVSS

SEQ ID NO: 6562 - protein, 8 aa, synthetic construct
  REGION 1..8: note = lupartumab heavy chain CDR1
GFTFSNAW

SEQ ID NO: 6563 - protein, 8 aa, synthetic construct
  REGION 1..8: note = lupartumab heavy chain CDR2
ISSSGSTI

SEQ ID NO: 6564 - protein, 10 aa, synthetic construct
  REGION 1..10: note = lupartumab heavy chain CDR3
AREGLWAFDY

SEQ ID NO: 6565 - protein, 111 aa, synthetic construct
  REGION 1..111: note = lupartumab light chain V region
ESVLTQPPSVSGAPGQRVTISCTGSSSNIGAGYVVHWYQQLPGTAPKLLIYDNNKRPSGVPDRFSGSKSGTSASLAISGLRSEDEADYYCAAWDDRLNGPVFGGGTKLTVL

SEQ ID NO: 6566 - protein, 9 aa, synthetic construct
  REGION 1..9: note = lupartumab light chain CDR1
SSNIGAGYV

SEQ ID NO: 6567 - skipped

SEQ ID NO: 6568 - protein, 11 aa, synthetic construct
  REGION 1..11: note = lupartumab light chain CDR3
AAWDDRLNGPV

SEQ ID NO: 6569 - protein, 117 aa, synthetic construct; identical to SEQ ID NO: 6561
  REGION 1..117: note = lupartumab amadotin heavy chain V region

SEQ ID NO: 6570 - protein, 8 aa, synthetic construct
  REGION 1..8: note = lupartumab amadotin heavy chain CDR1
GFTFSNAW

SEQ ID NO: 6571 - protein, 8 aa, synthetic construct
  REGION 1..8: note = lupartumab amadotin heavy chain CDR2
ISSSGSTI

SEQ ID NO: 6572 - protein, 10 aa, synthetic construct
  REGION 1..10: note = lupartumab amadotin heavy chain CDR3
AREGLWAFDY

SEQ ID NO: 6573 - protein, 111 aa, synthetic construct; identical to SEQ ID NO: 6565
  REGION 1..111: note = lupartumab amadotin light chain V region

SEQ ID NO: 6574 - protein, 9 aa, synthetic construct
  REGION 1..9: note = lupartumab amadotin light chain CDR1
SSNIGAGYV

SEQ ID NO: 6575 - skipped

SEQ ID NO: 6576 - protein, 11 aa, synthetic construct
  REGION 1..11: note = lupartumab amadotin light chain CDR3
AAWDDRLNGPV

SEQ ID NO: 6577 - protein, 118 aa, synthetic construct
  REGION 1..118: note = maftivimab heavy chain V region
EVQLVESGGGLVQPGGSLRLSCAASGFTSSSYAMNWVRQAPGKGLEWVSTISGMGGSTYYADSVKGRFTISRDNSKNTLYLQMNSLRAEDTAVYYCAKRGYPHSFDIWGQGTMVTVSS

SEQ ID NO: 6578 - protein, 7 aa, synthetic construct
  REGION 1..7: note = maftivimab heavy chain CDR1
GFTSSSY

SEQ ID NO: 6579 - protein, 8 aa, synthetic construct
  REGION 1..8: note = maftivimab heavy chain CDR2
ISGMGGST

SEQ ID NO: 6580 - protein, 11 aa, synthetic construct
  REGION 1..11: note = maftivimab heavy chain CDR3
AKRGYPHSFDI

SEQ ID NO: 6581 - protein, 106 aa, synthetic construct
  REGION 1..106: note = maftivimab light chain V region
DIQMTQSPSSLSASVGDRVTITCRASQSISSFLNWYQQKPGKAPKLLIYAASSLQSGVPSRFSGSGSGTDFTLTISSLQPEDFATYYCQQSYSTLTFGQGTRLEIK

SEQ ID NO: 6582 - protein, 6 aa, synthetic construct
  REGION 1..6: note = maftivimab light chain CDR1
QSISSF

SEQ ID NO: 6583 - skipped

SEQ ID NO: 6584 - protein, 8 aa, synthetic construct
  REGION 1..8: note = maftivimab light chain CDR3
QQSYSTLT

SEQ ID NO: 6585 - protein, 122 aa, synthetic construct
  REGION 1..122: note = manelimab heavy chain V region
EVQLVESGGGVVRPGGSLRLSCAASGFTFDDYAMSWVRQAPGKGLEWVSDISWSGSNTNYADSVKGRFTISRDNAKNSLYLQMNSLRAEDTALYHCARAPLLLAMTFGVGSWGQGTLVTVSS

SEQ ID NO: 6586 - protein, 8 aa, synthetic construct
  REGION 1..8: note = manelimab heavy chain CDR1
GFTFDDYA

SEQ ID NO: 6587 - protein, 8 aa, synthetic construct
  REGION 1..8: note = manelimab heavy chain CDR2
ISWSGSNT

SEQ ID NO: 6588 - protein, 15 aa, synthetic construct
  REGION 1..15: note = manelimab heavy chain CDR3
ARAPLLLAMTFGVGS

SEQ ID NO: 6589 - protein, 110 aa, synthetic construct
  REGION 1..110: note = manelimab light chain V region
QTVVTQEPSLSVSPGGTVTLTCGLSSGTVTAINYPGWYQQTPGQAPRTLIYNTNTRHSGVPDRFSGSISGNKAALTITGAQAEDEADYYCALYMGNGGHMFGGGTKLTVL

SEQ ID NO: 6590 - protein, 9 aa, synthetic construct
  REGION 1..9: note = manelimab light chain CDR1
SGTVTAINY

SEQ ID NO: 6591 - skipped

SEQ ID NO: 6592 - protein, 10 aa, synthetic construct
  REGION 1..10: note = manelimab light chain CDR3
ALYMGNGGHM

SEQ ID NO: 6593 - protein, 120 aa, synthetic construct
  REGION 1..120: note = margetuximab heavy chain V region
QVQLQQSGPELVKPGASLKLSCTASGFNIKDTYIHWVKQRPEQGLEWIGRIYPTNGYTRYDPKFQDKATITADTSSNTAYLQVSRLTSEDTAVYYCSRWGGDGFYAMDYWGQGASVTVSS

SEQ ID NO: 6594 - protein, 8 aa, synthetic construct
  REGION 1..8: note = margetuximab heavy chain CDR1
GFNIKDTY

SEQ ID NO: 6595 - protein, 8 aa, synthetic construct
  REGION 1..8: note = margetuximab heavy chain CDR2
IYPTNGYT

SEQ ID NO: 6596 - protein, 13 aa, synthetic construct
  REGION 1..13: note = margetuximab heavy chain CDR3
SRWGGDGFYAMDY

SEQ ID NO: 6597 - protein, 107 aa, synthetic construct
  REGION 1..107: note = margetuximab light chain V region
DIVMTQSHKFMSTSVGDRVSITCKASQDVNTAVAWYQQKPGHSPKLLIYSASFRYTGVPDRFTGSRSGTDFTFTISSVQAEDLAVYYCQQHYTTPPTFGGGTKVEIK

SEQ ID NO: 6598 - protein, 5 aa, synthetic construct
  REGION 1..5: note = margetuximab light chain CDR1
QDVNT

SEQ ID NO: 6599 - skipped

SEQ ID NO: 6600 - protein, 9 aa, synthetic construct
  REGION 1..9: note = margetuximab light chain CDR3
QQHYTTPPT

SEQ ID NO: 6601 - protein, 120 aa, synthetic construct
  REGION 1..120: note = marstacimab heavy chain V region
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAILGATSLSAFDIWGQGTMVTVSS

SEQ ID NO: 6602 - protein, 7 aa, synthetic construct
  REGION 1..7: note = marstacimab heavy chain CDR1
GFTFSSY

SEQ ID NO: 6603 - protein, 8 aa, synthetic construct
  REGION 1..8: note = marstacimab heavy chain CDR2
ISGSGGST

SEQ ID NO: 6604 - protein, 13 aa, synthetic construct
  REGION 1..13: note = marstacimab heavy chain CDR3
AILGATSLSAFDI

SEQ ID NO: 6605 - protein, 112 aa, synthetic construct
  REGION 1..112: note = marstacimab light chain V region
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSGVFGGGTKLTVL

SEQ ID NO: 6606 - protein, 9 aa, synthetic construct
  REGION 1..9: note = marstacimab light chain CDR1
SSNIGAGYD

SEQ ID NO: 6607 - skipped

SEQ ID NO: 6608 - protein, 12 aa, synthetic construct
  REGION 1..12: note = marstacimab light chain CDR3
QSYDSSLSGSGV

SEQ ID NO: 6609 - protein, 120 aa, synthetic construct
  REGION 1..120: note = mavrilimumab heavy chain V region
QVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSS

SEQ ID NO: 6610 - protein, 8 aa, synthetic construct
  REGION 1..8: note = mavrilimumab heavy chain CDR1
GYTLTELS

SEQ ID NO: 6611 - protein, 8 aa, synthetic construct
  REGION 1..8: note = mavrilimumab heavy chain CDR2
FDPEENEI

SEQ ID NO: 6612 - protein, 13 aa, synthetic construct
  REGION 1..13: note = mavrilimumab heavy chain CDR3
AIVGSFSPLTLGL

SEQ ID NO: 6613 - protein, 111 aa, synthetic construct
  REGION 1..111: note = mavrilimumab light chain V region
QSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVL

SEQ ID NO: 6614 - protein, 9 aa, synthetic construct
  REGION 1..9: note = mavrilimumab light chain CDR1
GSNIGAPYD

SEQ ID NO: 6615 - skipped

SEQ ID NO: 6616 - protein, 11 aa, synthetic construct
  REGION 1..11: note = mavrilimumab light chain CDR3
ATVEAGLSGSV

SEQ ID NO: 6617 - protein, 115 aa, synthetic construct
  REGION 1..115: note = melredableukin alfa heavy chain V region
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGSGFDYWGQGTLVTVSS

SEQ ID NO: 6618 - protein, 7 aa, synthetic construct
  REGION 1..7: note = melredableukin alfa heavy chain CDR1
GFTFSSY

SEQ ID NO: 6619 - protein, 8 aa, synthetic construct
  REGION 1..8: note = melredableukin alfa heavy chain CDR2
ISGSGGST

SEQ ID NO: 6620 - protein, 8 aa, synthetic construct
  REGION 1..8: note = melredableukin alfa heavy chain CDR3
AKGSGFDY

SEQ ID NO: 6621 - protein, 108 aa, synthetic construct
  REGION 1..108: note = melredableukin alfa light chain V region
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGQGTKVEIK

SEQ ID NO: 6622 - protein, 7 aa, synthetic construct
  REGION 1..7: note = melredableukin alfa light chain CDR1
QSVSSSY

SEQ ID NO: 6623 - skipped

SEQ ID NO: 6624 - protein, 9 aa, synthetic construct
  REGION 1..9: note = melredableukin alfa light chain CDR3
QQYGSSPLT

SEQ ID NO: 6625 - protein, 123 aa, synthetic construct
  REGION 1..123: note = melrilimab heavy chain V region
EVQLLESGGGLVQPGGSLRLSCAASGFTFSIYDMIWVRQAPGKGLEWVSSIRGEGGGTYYADSVKGRFTISRDNSKNTLYLQMNSLRAEDTAVYYCARDPWSTEGSFFVLDYWGQGTLVTVSS

SEQ ID NO: 6626 - protein, 8 aa, synthetic construct
  REGION 1..8: note = melrilimab heavy chain CDR1
GFTFSIYD

SEQ ID NO: 6627 - protein, 8 aa, synthetic construct
  REGION 1..8: note = melrilimab heavy chain CDR2
IRGEGGGT

SEQ ID NO: 6628 - protein, 16 aa, synthetic construct
  REGION 1..16: note = melrilimab heavy chain CDR3
ARDPWSTEGSFFVLDY

SEQ ID NO: 6629 - protein, 107 aa, synthetic construct
  REGION 1..107: note = melrilimab light chain V region
EIVLTQSPATLSLSPGERATLSCRASQSVDDDLAWYQQKPGQAPRLLIYDASNRATGIPARFSGSGSGTDFTLTISSLEPEDFAVYYCQQYITAPLTFGQGTKVEIK

SEQ ID NO: 6630 - protein, 6 aa, synthetic construct
  REGION 1..6: note = melrilimab light chain CDR1
QSVDDD

SEQ ID NO: 6631 - skipped

SEQ ID NO: 6632 - protein, 9 aa, synthetic construct
  REGION 1..9: note = melrilimab light chain CDR3
QQYITAPLT

SEQ ID NO: 6633 - protein, 119 aa, synthetic construct
  REGION 1..119: note = mibavademab heavy chain V region
QVQLVESGGSVVQPGRSLRLSCAASGFTFSTYAMYWVRQTPGKGLEWVAVLYSDGSNKYYIDSVKGRFTISRDTSTNTLYLQMSSLRADDSALYYCARLNWDYWYFDLWGRGTLVTVSS

SEQ ID NO: 6634 - protein, 8 aa, synthetic construct
  REGION 1..8: note = mibavademab heavy chain CDR1
GFTFSTYA

SEQ ID NO: 6635 - protein, 8 aa, synthetic construct
  REGION 1..8: note = mibavademab heavy chain CDR2
LYSDGSNK

SEQ ID NO: 6636 - protein, 12 aa, synthetic construct
  REGION 1..12: note = mibavademab heavy chain CDR3
ARLNWDYWYFDL

SEQ ID NO: 6637 - protein, 108 aa, synthetic construct
  REGION 1..108: note = mibavademab light chain V region
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPITFGQGTRLEIK

SEQ ID NO: 6638 - protein, 6 aa, synthetic construct
  REGION 1..6: note = mibavademab light chain CDR1
QSISSY

SEQ ID NO: 6639 - skipped

SEQ ID NO: 6640 - protein, 10 aa, synthetic construct
  REGION 1..10: note = mibavademab light chain CDR3
QQSYSTPPIT

SEQ ID NO: 6641 - protein, 116 aa, synthetic construct
  REGION 1..116: note = mirzotamab heavy chain V region
EVQLQESGPGLVKPSETLSLTCAVTGYSITSGYSWHWIRQFPGNGLEWMGYIHSSGSTNYNPSLKSRISISRDTSKNQFFLKLSSVTAADTAVYYCAGYDDYFEYWGQGTTVTVSS

SEQ ID NO: 6642 - protein, 9 aa, synthetic construct
  REGION 1..9: note = mirzotamab heavy chain CDR1
GYSITSGYS

SEQ ID NO: 6643 - protein, 7 aa, synthetic construct
  REGION 1..7: note = mirzotamab heavy chain CDR2
IHSSGST

SEQ ID NO: 6644 - protein, 9 aa, synthetic construct
  REGION 1..9: note = mirzotamab heavy chain CDR3
AGYDDYFEY

SEQ ID NO: 6645 - protein, 107 aa, synthetic construct
  REGION 1..107: note = mirzotamab light chain V region
DIQMTQSPSSLSASVGDRVTITCKASQNVGFNVAWYQQKPGKSPKALIYSASYRYSGVPSRFSGSGSGTDFTLTISSLQPEDFAEYFCQQYNWYPFTFGQGTKLEIK

SEQ ID NO: 6646 - protein, 6 aa, synthetic construct
  REGION 1..6: note = mirzotamab light chain CDR1
QNVGFN

SEQ ID NO: 6647 - skipped

SEQ ID NO: 6648 - protein, 10 aa, synthetic construct
  REGION 1..10: note = mirzotamab light chain CDR3
QQYNWYPFTF

SEQ ID NO: 6649 - protein, 116 aa, synthetic construct; identical to SEQ ID NO: 6641
  REGION 1..116: note = mirzotamab clezutoclax heavy chain V region

SEQ ID NO: 6650 - protein, 9 aa, synthetic construct
  REGION 1..9: note = mirzotamab clezutoclax heavy chain CDR1
GYSITSGYS

SEQ ID NO: 6651 - protein, 7 aa, synthetic construct
  REGION 1..7: note = mirzotamab clezutoclax heavy chain CDR2
IHSSGST

SEQ ID NO: 6652 - protein, 9 aa, synthetic construct
  REGION 1..9: note = mirzotamab clezutoclax heavy chain CDR3
AGYDDYFEY

SEQ ID NO: 6653 - protein, 107 aa, synthetic construct; identical to SEQ ID NO: 6645
  REGION 1..107: note = mirzotamab clezutoclax light chain V region

SEQ ID NO: 6654 - protein, 7 aa, synthetic construct
  REGION 1..7: note = mirzotamab clezutoclax light chain CDR1
QNVGFNV

SEQ ID NO: 6655 - skipped

SEQ ID NO: 6656 - protein, 9 aa, synthetic construct
  REGION 1..9: note = mirzotamab clezutoclax light chain CDR3
QQYNWYPFT

SEQ ID NO: 6657 - protein, 119 aa, synthetic construct
  REGION 1..119: note = mogamulizumab heavy chain V region
EVQLVESGGDLVQPGRSLRLSCAASGFIFSNYGMSWVRQAPGKGLEWVATISSASTYSYYPDSVKGRFTISRDNAKNSLYLQMNSLRVEDTALYYCGRHSDGNFAFGYWGQGTLVTVSS

SEQ ID NO: 6658 - protein, 7 aa, synthetic construct
  REGION 1..7: note = mogamulizumab heavy chain CDR1
GFIFSNY

SEQ ID NO: 6659 - protein, 8 aa, synthetic construct
  REGION 1..8: note = mogamulizumab heavy chain CDR2
ISSASTYS

SEQ ID NO: 6660 - protein, 12 aa, synthetic construct
  REGION 1..12: note = mogamulizumab heavy chain CDR3
GRHSDGNFAFGY

SEQ ID NO: 6661 - protein, 112 aa, synthetic construct
  REGION 1..112: note = mogamulizumab light chain V region
DVLMTQSPLSLPVTPGEPASISCRSSRNIVHINGDTYLEWYLQKPGQSPQLLIYKVSNRFSGVPDRFSGSGSGTDFTLKISRVEAEDVGVYYCFQGSLLPWTFGQGTKVEIK

SEQ ID NO: 6662 - protein, 11 aa, synthetic construct
  REGION 1..11: note = mogamulizumab light chain CDR1
RNIVHINGDTY

SEQ ID NO: 6663 - skipped

SEQ ID NO: 6664 - protein, 9 aa, synthetic construct
  REGION 1..9: note = mogamulizumab light chain CDR3
FQGSLLPWT

SEQ ID NO: 6665 - protein, 124 aa, synthetic construct
  REGION 1..124: note = moxetumomab pasudotox heavy chain V region
MEVQLVESGGGLVKPGGSLKLSCAASGFAFSIYDMSWVRQTPEKCLEWVAYISSGGGTTYYPDTVKGRFTISRDNAKNTLYLQMSSLKSEDTAMYYCARHSGYGTHWGVLFAYWGQGTLVTVSA

SEQ ID NO: 6666 - protein, 8 aa, synthetic construct
  REGION 1..8: note = moxetumomab pasudotox heavy chain CDR1
GFAFSIYD

SEQ ID NO: 6667 - protein, 8 aa, synthetic construct
  REGION 1..8: note = moxetumomab pasudotox heavy chain CDR2
ISSGGGTT

SEQ ID NO: 6668 - protein, 16 aa, synthetic construct
  REGION 1..16: note = moxetumomab pasudotox heavy chain CDR3
ARHSGYGTHWGVLFAY

SEQ ID NO: 6669 - protein, 108 aa, synthetic construct
  REGION 1..108: note = moxetumomab pasudotox light chain V region
MDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGCGTKLEIK

SEQ ID NO: 6670 - protein, 6 aa, synthetic construct
  REGION 1..6: note = moxetumomab pasudotox light chain CDR1
QDISNY

SEQ ID NO: 6671 - skipped

SEQ ID NO: 6672 - protein, 9 aa, synthetic construct
  REGION 1..9: note = moxetumomab pasudotox light chain CDR3
QQGNTLPWT

SEQ ID NO: 6673 - protein, 124 aa, synthetic construct
  REGION 1..124: note = nadecnemab heavy chain V region
EVQLVESGGGLVQPGGSLRLSCAASGFTFSSYAMSWVRQAPGKGLEWVSVISGSGGSTYYADAVKGRFTISRDNSKHTLYLQMNSLRAEDTAVYYCTKPSSYSSSNFYYGMDVWGQGTTVTVSS

SEQ ID NO: 6674 - protein, 7 aa, synthetic construct
  REGION 1..7: note = nadecnemab heavy chain CDR1
GFTFSSY

SEQ ID NO: 6675 - protein, 8 aa, synthetic construct
  REGION 1..8: note = nadecnemab heavy chain CDR2
ISGSGGST

SEQ ID NO: 6676 - protein, 17 aa, synthetic construct
  REGION 1..17: note = nadecnemab heavy chain CDR3
TKPSSYSSSNFYYGMDV

SEQ ID NO: 6677 - protein, 107 aa, synthetic construct
  REGION 1..107: note = nadecnemab light chain V region
DIQMTQSPSSVSASVGDRVTITCRASQGISSWLAWYQQKPGKAPKLLIYAASSLQSGVPSRFSGSGSGTDFTLTISSLQPEDFATYYCQQTNSFPFPFGPGTKVDIK

SEQ ID NO: 6678 - protein, 6 aa, synthetic construct
  REGION 1..6: note = nadecnemab light chain CDR1
QGISSW

SEQ ID NO: 6679 - skipped

SEQ ID NO: 6680 - protein, 9 aa, synthetic construct
  REGION 1..9: note = nadecnemab light chain CDR3
QQTNSFPFP

SEQ ID NO: 6681 - protein, 119 aa, synthetic construct
  REGION 1..119: note = namilumab heavy chain V region
QVQLVQSGAEVKKPGASVKVSCKAFGYPFTDYLLHWVRQAPGQGLEWVGWLNPYSGDTNYAQKFQGRVTMTRDTSISTAYMELSRLRSDDTAVYYCTRTTLISVYFDYWGQGTMVTVSS

SEQ ID NO: 6682 - protein, 8 aa, synthetic construct
  REGION 1..8: note = namilumab heavy chain CDR1
GYPFTDYL

SEQ ID NO: 6683 - protein, 8 aa, synthetic construct
  REGION 1..8: note = namilumab heavy chain CDR2
LNPYSGDT

SEQ ID NO: 6684 - protein, 12 aa, synthetic construct
  REGION 1..12: note = namilumab heavy chain CDR3
TRTTLISVYFDY

SEQ ID NO: 6685 - protein, 107 aa, synthetic construct
  REGION 1..107: note = namilumab light chain V region
DIQMTQSPSSVSASVGDRVTIACRASQNIRNILNWYQQRPGKAPQLLIYAASNLQSGVPSRFSGSGSGTDFTLTINSLQPEDFATYYCQQSYSMPRTFGGGTKLEIK

SEQ ID NO: 6686 - protein, 6 aa, synthetic construct
  REGION 1..6: note = namilumab light chain CDR1
QNIRNI

SEQ ID NO: 6687 - skipped

SEQ ID NO: 6688 - protein, 9 aa, synthetic construct
  REGION 1..9: note = namilumab light chain CDR3
QQSYSMPRT

SEQ ID NO: 6689 - protein, 122 aa, synthetic construct
  REGION 1..122: note = narnatumab heavy chain V region
EVQLVESGGGLVQPGGSLRLSCAASGFTFSSYLMTWVRQAPGKGLEWVANIKQDGSEKYYVDSVKGRFTISRDNAKNSLNLQMNSLRAEDTAVYYCTRDGYSSGRHYGMDVWGQGTTVIVSS

SEQ ID NO: 6690 - protein, 7 aa, synthetic construct
  REGION 1..7: note = narnatumab heavy chain CDR1
GFTFSSY

SEQ ID NO: 6691 - protein, 8 aa, synthetic construct
  REGION 1..8: note = narnatumab heavy chain CDR2
IKQDGSEK

SEQ ID NO: 6692 - protein, 15 aa, synthetic construct
  REGION 1..15: note = narnatumab heavy chain CDR3
TRDGYSSGRHYGMDV

SEQ ID NO: 6693 - protein, 107 aa, synthetic construct
  REGION 1..107: note = narnatumab light chain V region
EIVLTQSPATLSLSPGERATLSCRASQSVSRYLAWYQQKPGQAPRLLIYDASNRATGIPARFSGSGSGTDFTLTISSLEPEDFAVYYCQQRSNWPRTFGQGTKVEIK

SEQ ID NO: 6694 - protein, 6 aa, synthetic construct
  REGION 1..6: note = narnatumab light chain CDR1
QSVSRY

SEQ ID NO: 6695 - skipped

SEQ ID NO: 6696 - protein, 9 aa, synthetic construct
  REGION 1..9: note = narnatumab light chain CDR3
QQRSNWPRT

SEQ ID NO: 6697 - protein, 118 aa, synthetic construct
  REGION 1..118: note = narsoplimab heavy chain V region
QVTLKESGPVLVKPTETLTLTCTVSGFSLSRGKMGVSWIRQPPGKALEWLAHIFSSDEKSYRTSLKSRLTISKDTSKNQVVLTMTNMDPVDTATYYCARIRRGGIDYWGQGTLVTVSS

SEQ ID NO: 6698 - protein, 10 aa, synthetic construct
  REGION 1..10: note = narsoplimab heavy chain CDR1
GFSLSRGKMG

SEQ ID NO: 6699 - protein, 7 aa, synthetic construct
  REGION 1..7: note = narsoplimab heavy chain CDR2
IFSSDEK

SEQ ID NO: 6700 - protein, 10 aa, synthetic construct
  REGION 1..10: note = narsoplimab heavy chain CDR3
ARIRRGGIDY

SEQ ID NO: 6701 - protein, 106 aa, synthetic construct
  REGION 1..106: note = narsoplimab light chain V region
QPVLTQPPSLSVSPGQTASITCSGEKLGDKYAYWYQQKPGQSPVLVMYQDKQRPSGIPERFSGSNSGNTATLTISGTQAMDEADYYCQAWDSSTAVFGGGTKLTVL

SEQ ID NO: 6702 - protein, 6 aa, synthetic construct
  REGION 1..6: note = narsoplimab light chain CDR1
KLGDKY

SEQ ID NO: 6703 - skipped

SEQ ID NO: 6704 - protein, 9 aa, synthetic construct
  REGION 1..9: note = narsoplimab light chain CDR3
QAWDSSTAV

SEQ ID NO: 6705 - protein, 126 aa, synthetic construct [sequence omitted]

SEQ ID NO: 6706 - protein, 8 aa, synthetic construct
  REGION 1..8: note = navivumab heavy chain CDR1
GYSFSTYG

SEQ ID NO: 6707 - protein, 8 aa, synthetic construct
  REGION 1..8: note = navivumab heavy chain CDR2
ISAYTGIT

SEQ ID NO: 6708 - protein, 19 aa, synthetic construct
  REGION 1..19: note = navivumab heavy chain CDR3
ARDKVQGRVEVGSGGRHDY

SEQ ID NO: 6709 - protein, 108 aa, synthetic construct [sequence omitted]

SEQ ID NO: 6710 - protein, 7 aa, synthetic construct
  REGION 1..7: note = navivumab light chain CDR1
HRVGSTY

SEQ ID NO: 6711 - skipped

SEQ ID NO: 6712 - protein, 9 aa, synthetic construct
  REGION 1..9: note = navivumab light chain CDR3
QQFSVSPWT

SEQ ID NO: 6713 - protein, 119 aa, synthetic construct
  REGION 1..119: note = naxitamab heavy chain V region
QVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSS

SEQ ID NO: 6714 - protein, 8 aa, synthetic construct
  REGION 1..8: note = naxitamab heavy chain CDR1
GFSVTNYG

SEQ ID NO: 6715 - protein, 7 aa, synthetic construct
  REGION 1..7: note = naxitamab heavy chain CDR2
IWAGGIT

SEQ ID NO: 6716 - protein, 13 aa, synthetic construct
  REGION 1..13: note = naxitamab heavy chain CDR3
ASRGGHYGYALDY

SEQ ID NO: 6717 - protein, 104 aa, synthetic construct
  REGION 1..104: note = naxitamab light chain V region
EIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIK

SEQ ID NO: 6718 - protein, 6 aa, synthetic construct
  REGION 1..6: note = naxitamab light chain CDR1
QSVSND

SEQ ID NO: 6719 - skipped

SEQ ID NO: 6720 - protein, 6 aa, synthetic construct
  REGION 1..6: note = naxitamab light chain CDR3
QQDYSS

SEQ ID NO: 6721 - protein, 121 aa, synthetic construct [sequence omitted]

SEQ ID NO: 6722 - protein, 10 aa, synthetic construct
  REGION 1..10: note = necitumumab heavy chain CDR1
GGSISSGDYY

SEQ ID NO: 6723 - protein, 7 aa, synthetic construct
  REGION 1..7: note = necitumumab heavy chain CDR2
IYYSGST

SEQ ID NO: 6724 - protein, 13 aa, synthetic construct
  REGION 1..13: note = necitumumab heavy chain CDR3
ARVSIFGVGTFDY

SEQ ID NO: 6725 - protein, 107 aa, synthetic construct [sequence omitted]

SEQ ID NO: 6726 - protein, 6 aa, synthetic construct
  REGION 1..6: note = necitumumab light chain CDR1
QSVSSY

SEQ ID NO: 6727 - skipped

SEQ ID NO: 6728 - protein, 9 aa, synthetic construct
  REGION 1..9: note = necitumumab light chain CDR3
HQYGSTPLT

SEQ ID NO: 6729 - protein, 122 aa, synthetic construct
  REGION 1..122: note = nesvacumab heavy chain V region
EVQLVESGGGLVQPGGSLRLSCAASGFTFSSYDIHWVRQATGKGLEWVSAIGPAGDTYYPGSVKGRFTISRENAKNSLYLQMNSLRAGDTAVYYCARGLITFGGLIAPFDYWGQGTLVTVSS

SEQ ID NO: 6730 - protein, 7 aa, synthetic construct
  REGION 1..7: note = nesvacumab heavy chain CDR1
GFTFSSY

SEQ ID NO: 6731 - protein, 7 aa, synthetic construct
  REGION 1..7: note = nesvacumab heavy chain CDR2
IGPAGDT

SEQ ID NO: 6732 - protein, 16 aa, synthetic construct
  REGION 1..16: note = nesvacumab heavy chain CDR3
ARGLITFGGLIAPFDY

SEQ ID NO: 6733 - protein, 107 aa, synthetic construct
  REGION 1..107: note = nesvacumab light chain V region
EIVLTQSPGTLSLSPGERATLSCRASQSVSSTYLAWYQQKPGQAPRLLIYGASSRATGIPDRFSGSGSGTDFTLTISRLEPEDFAVYYCQHYDNSQTFGQGTKVEIK

SEQ ID NO: 6734 - protein, 6 aa, synthetic construct
  REGION 1..6: note = nesvacumab light chain CDR1
QSVSST

SEQ ID NO: 6735 - skipped

SEQ ID NO: 6736 - protein, 8 aa, synthetic construct
  REGION 1..8: note = nesvacumab light chain CDR3
QHYDNSQT

SEQ ID NO: 6737 - protein, 125 aa, synthetic construct
  REGION 1..125: note = netakimab heavy chain V region
QVQLVQSGGGLVQAGGSLRLSCAASGGTFATSPMGWLRQAPGKGTEFVAAISPSGGDRIYADSVKGRFTISRDNAGYFIYLQMNSLKPEDTAVYYCAVRRRFDGTSYYTGDYDSWGQGTLVTVSS

SEQ ID NO: 6738 - protein, 8 aa, synthetic construct
  REGION 1..8: note = netakimab heavy chain CDR1
GGTFATSP

SEQ ID NO: 6739 - protein, 7 aa, synthetic construct
  REGION 1..7: note = netakimab heavy chain CDR2
ISPSGGD

SEQ ID NO: 6740 - protein, 19 aa, synthetic construct
  REGION 1..19: note = netakimab heavy chain CDR3
CAVRRRFDGTSYYTGDYDS

SEQ ID NO: 6741 - protein, 108 aa, synthetic construct
  REGION 1..108: note = netakimab light chain V region
EIVLTQSPGTLSLSPGERATLSCRASQSVSSSYLAWYQQKPGQAPRLLIYDASSRATGIPDRFSGSGSGTDFTLTISRLEPEDFAVYYCQQYSYSPVTFGQGTKVEIK

SEQ ID NO: 6742 - protein, 7 aa, synthetic construct
  REGION 1..7: note = netakimab light chain CDR1
QSVSSSY

SEQ ID NO: 6743 - skipped

SEQ ID NO: 6744 - protein, 9 aa, synthetic construct
  REGION 1..9: note = netakimab light chain CDR3
QQYSYSPVT

SEQ ID NO: 6745 - protein, 116 aa, synthetic construct
  REGION 1..116: note = nipocalimab heavy chain V region
EVQLLESGGGLVQPGGSLRLSCAASGFTFSTYAMGWVRQAPGKGLEWVSSIGASGSQTRYADSVKGRFTISRDNSKNTLYLQMNSLRAEDTAVYYCARLAIGDSYWGQGTMVTVSS

SEQ ID NO: 6746 - protein, 7 aa, synthetic construct
  REGION 1..7: note = nipocalimab heavy chain CDR1
GFTFSTY

SEQ ID NO: 6747 - protein, 8 aa, synthetic construct
  REGION 1..8: note = nipocalimab heavy chain CDR2
IGASGSQT

SEQ ID NO: 6748 - protein, 9 aa, synthetic construct
  REGION 1..9: note = nipocalimab heavy chain CDR3
ARLAIGDSY

SEQ ID NO: 6749 - protein, 110 aa, synthetic construct
  REGION 1..110: note = nipocalimab light chain V region
QSALTQPASVSGSPGQSITISCTGTGSDVGSYNLVSWYQQHPGKAPKLMIYGDSERPSGVSNRFSGSKSGNTASLTISGLQAEDEADYYCSSYAGSGIYVFGTGTKVTVL

SEQ ID NO: 6750 - protein, 9 aa, synthetic construct
  REGION 1..9: note = nipocalimab light chain CDR1
GSDVGSYNL

SEQ ID NO: 6751 - skipped

SEQ ID NO: 6752 - protein, 10 aa, synthetic construct
  REGION 1..10: note = nipocalimab light chain CDR3
SSYAGSGIYV

SEQ ID NO: 6753 - protein, 113 aa, synthetic construct [sequence omitted]

SEQ ID NO: 6754 - protein, 8 aa, synthetic construct
  REGION 1..8: note = nivolumab heavy chain CDR1
GITFSNSG

SEQ ID NO: 6755 - protein, 8 aa, synthetic construct
  REGION 1..8: note = nivolumab heavy chain CDR2
IWYDGSKR

SEQ ID NO: 6756 - protein, 6 aa, synthetic construct
  REGION 1..6: note = nivolumab heavy chain CDR3
ATNDDY

SEQ ID NO: 6757 - protein, 107 aa, synthetic construct [sequence omitted]

SEQ ID NO: 6758 - protein, 6 aa, synthetic construct
  REGION 1..6: note = nivolumab light chain CDR1
QSVSSY

SEQ ID NO: 6759 - skipped

SEQ ID NO: 6760 - protein, 9 aa, synthetic construct
  REGION 1..9: note = nivolumab light chain CDR3
QQSSNWPRT

SEQ ID NO: 6761 - protein, 118 aa, synthetic construct
  REGION 1..118: note = nurulimab heavy chain V region
EVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 6762 - protein, 7 aa, synthetic construct
  REGION 1..7: note = nurulimab heavy chain CDR1
GFTFSSY

SEQ ID NO: 6763 - protein, 8 aa, synthetic construct
  REGION 1..8: note = nurulimab heavy chain CDR2
ISYDGNNK

SEQ ID NO: 6764 - protein, 11 aa, synthetic construct
  REGION 1..11: note = nurulimab heavy chain CDR3
ARTGWLGPFDY

SEQ ID NO: 6765 - protein, 108 aa, synthetic construct; identical to SEQ ID NO: 6389
  REGION 1..108: note = nurulimab light chain V region

SEQ ID NO: 6766 - protein, 7 aa, synthetic construct
  REGION 1..7: note = nurulimab light chain CDR1
QSVGSSY

SEQ ID NO: 6767 - skipped

SEQ ID NO: 6768 - protein, 9 aa, synthetic construct
  REGION 1..9: note = nurulimab light chain CDR3
QQYGSSPWT

SEQ ID NO: 6769 - protein, 119 aa, synthetic construct
  REGION 1..119: note = obiltoxaximab heavy chain V region
QVQLQQSGPELKKPGASVKVSCKDSGYAFSSSWMNWVRQAPGQGLEWIGRIYPGDGDTNYNGKFQGRVTITADKSSSTAYMELSSLRSEDTAVYFCARSGLLRYAMDYWGQGTLVTVSS

SEQ ID NO: 6770 - protein, 8 aa, synthetic construct
  REGION 1..8: note = obiltoxaximab heavy chain CDR1
GYAFSSSW

SEQ ID NO: 6771 - protein, 8 aa, synthetic construct
  REGION 1..8: note = obiltoxaximab heavy chain CDR2
IYPGDGDT

SEQ ID NO: 6772 - protein, 12 aa, synthetic construct
  REGION 1..12: note = obiltoxaximab heavy chain CDR3
ARSGLLRYAMDY

SEQ ID NO: 6773 - protein, 107 aa, synthetic construct
  REGION 1..107: note = obiltoxaximab light chain V region
DIQMTQSPSSLSASVGDRVTITCRASQDIRNYLNWYQQKPGKAVKLLIYYTSRLLPGVPSRFSGSGSGTDYSLTISSQEQEDIGTYFCQQGNTLPWTFGQGTKVEIR

SEQ ID NO: 6774 - protein, 6 aa, synthetic construct
  REGION 1..6: note = obiltoxaximab light chain CDR1
QDIRNY

SEQ ID NO: 6775 - skipped

SEQ ID NO: 6776 - protein, 9 aa, synthetic construct
  REGION 1..9: note = obiltoxaximab light chain CDR3
QQGNTLPWT

SEQ ID NO: 6777 - protein, 119 aa, synthetic construct
  REGION 1..119: note = obinutuzumab heavy chain V region
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 6778 - protein, 8 aa, synthetic construct
  REGION 1..8: note = obinutuzumab heavy chain CDR1
GYAFSYSW

SEQ ID NO: 6779 - protein, 9 aa, synthetic construct
  REGION 1..9: note = obinutuzumab heavy chain CDR2
IFPGDGDTD

SEQ ID NO: 6780 - protein, 12 aa, synthetic construct
  REGION 1..12: note = obinutuzumab heavy chain CDR3
ARNVFDGYWLVY

SEQ ID NO: 6781 - protein, 112 aa, synthetic construct
  REGION 1..112: note = obinutuzumab light chain V region
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIK

SEQ ID NO: 6782 - protein, 11 aa, synthetic construct
  REGION 1..11: note = obinutuzumab light chain CDR1
KSLLHSNGITY

SEQ ID NO: 6783 - skipped

SEQ ID NO: 6784 - protein, 9 aa, synthetic construct
  REGION 1..9: note = obinutuzumab light chain CDR3
AQNLELPYT

SEQ ID NO: 6785 - protein, 118 aa, synthetic construct
  REGION 1..118: note = odesivimab heavy chain V region
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARTWFGELYFDYWGQGTLVTVSS

SEQ ID NO: 6786 - protein, 7 aa, synthetic construct
  REGION 1..7: note = odesivimab heavy chain CDR1
GFTFSSY

SEQ ID NO: 6787 - protein, 7 aa, synthetic construct
  REGION 1..7: note = odesivimab heavy chain CDR2
IGTAGDT

SEQ ID NO: 6788 - protein, 12 aa, synthetic construct
  REGION 1..12: note = odesivimab heavy chain CDR3
ARTWFGELYFDY

SEQ ID NO: 6789 - protein, 113 aa, synthetic construct
  REGION 1..113: note = odesivimab light chain V region
DIVMTQSPDSLAVSLGERATINCKSSQSVLYSSNNKNYLAWYQQKPGQPPKLLIYWASTRESGVPDRFSGSGSGTEFTLTITSLQAEDVAVYYCQQYYSSPLTFGGGTKVEIK

SEQ ID NO: 6790 - protein, 12 aa, synthetic construct
  REGION 1..12: note = odesivimab light chain CDR1
QSVLYSSNNKNY

SEQ ID NO: 6791 - skipped

SEQ ID NO: 6792 - protein, 9 aa, synthetic construct
  REGION 1..9: note = odesivimab light chain CDR3
QQYYSSPLT

SEQ ID NO: 6793 - protein, 127 aa, synthetic construct
  REGION 1..127: note = olaratumab heavy chain V region
QLQLQESGPGLVKPSETLSLTCTVSGGSINSSSYYWGWLRQSPGKGLEWIGSFFYTGSTYYNPSLRSRLTISVDTSKNQFSLMLSSVTAADTAVYYCARQSTYYYGSGNYYGWFDRWDQGTLVTVSS

SEQ ID NO: 6794 - protein, 9 aa, synthetic construct
  REGION 1..9: note = olaratumab heavy chain CDR1
GSINSSSYY

SEQ ID NO: 6795 - protein, 7 aa, synthetic construct
  REGION 1..7: note = olaratumab heavy chain CDR2
FFYTGST

SEQ ID NO: 6796 - protein, 19 aa, synthetic construct
  REGION 1..19: note = olaratumab heavy chain CDR3
ARQSTYYYGSGNYYGWFDR

SEQ ID NO: 6797 - protein, 107 aa, synthetic construct
  REGION 1..107: note = olaratumab light chain V region
EIVLTQSPATLSLSPGERATLSCRASQSVSSYLAWYQQKPGQAPRLLIYDASNRATGIPARFSGSGSGTDFTLTISSLEPEDFAVYYCQQRSNWPPAFGQGTKVEIK

SEQ ID NO: 6798 - protein, 7 aa, synthetic construct
  REGION 1..7: note = olaratumab light chain CDR1
QSVSSYL

SEQ ID NO: 6799 - skipped

SEQ ID NO: 6800 - protein, 9 aa, synthetic construct
  REGION 1..9: note = olaratumab light chain CDR3
QQRSNWPPA

SEQ ID NO: 6801 - protein, 117 aa, synthetic construct
  REGION 1..117: note = oleclumab heavy chain V region
EVQLLESGGGLVQPGGSLRLSCAASGFTFSSYAYSWVRQAPGKGLEWVSAISGSGGRTYYADSVKGRFTISRDNSKNTLYLQMNSLRAEDTAVYYCARLGYGRVDEWGRGTLVTVSS

SEQ ID NO: 6802 - protein, 7 aa, synthetic construct
  REGION 1..7: note = oleclumab heavy chain CDR1
GFTFSSY

SEQ ID NO: 6803 - protein, 8 aa, synthetic construct
  REGION 1..8: note = oleclumab heavy chain CDR2
ISGSGGRT

SEQ ID NO: 6804 - protein, 10 aa, synthetic construct
  REGION 1..10: note = oleclumab heavy chain CDR3
ARLGYGRVDE

SEQ ID NO: 6805 - protein, 110 aa, synthetic construct
  REGION 1..110: note = oleclumab light chain V region
QSVLTQPPSASGTPGQRVTISCSGSLSNIGRNPVNWYQQLPGTAPKLLIYLDNLRLSGVPDRFSGSKSGTSASLAISGLQSEDEADYYCATWDDSHPGWTFGGGTKLTVL

SEQ ID NO: 6806 - protein, 8 aa, synthetic construct
  REGION 1..8: note = oleclumab light chain CDR1
LSNIGRNP

SEQ ID NO: 6807 - skipped

SEQ ID NO: 6808 - protein, 11 aa, synthetic construct
  REGION 1..11: note = oleclumab light chain CDR3
ATWDDSHPGWT

SEQ ID NO: 6809 - protein, 121 aa, synthetic construct [sequence omitted]

SEQ ID NO: 6810 - protein, 8 aa, synthetic construct
  REGION 1..8: note = omalizumab heavy chain CDR1
GYSITSGY

SEQ ID NO: 6811 - protein, 8 aa, synthetic construct
  REGION 1..8: note = omalizumab heavy chain CDR2
SITYDGST

SEQ ID NO: 6812 - protein, 14 aa, synthetic construct
  REGION 1..14: note = omalizumab heavy chain CDR3
ARGSHYFGHWHFAV

SEQ ID NO: 6813 - protein, 111 aa, synthetic construct [sequence omitted]

SEQ ID NO: 6814 - protein, 10 aa, synthetic construct
  REGION 1..10: note = omalizumab light chain CDR1
QSVDYDGDSY

SEQ ID NO: 6815 - skipped

SEQ ID NO: 6816 - protein, 9 aa, synthetic construct
  REGION 1..9: note = omalizumab light chain CDR3
QQSHEDPYT

SEQ ID NO: 6817 - protein, 118 aa, synthetic construct
  REGION 1..118: note = omburtamab heavy chain V region
QVQLQQSGAELVKPGASVKLSCKASGYTFTNYDINWVRQRPEQGLEWIGWIFPGDGSTQYNEKFKGKATLTTDTSSSTAYMQLSRLTSEDSAVYFCARQTTATWFAYWGQGTLVTVSA

SEQ ID NO: 6818 - protein, 8 aa, synthetic construct
  REGION 1..8: note = omburtamab heavy chain CDR1
GYTFTNYD

SEQ ID NO: 6819 - protein, 8 aa, synthetic construct
  REGION 1..8: note = omburtamab heavy chain CDR2
IFPGDGST

SEQ ID NO: 6820 - protein, 214 aa, synthetic construct
  REGION 1..214: note = omburtamab heavy chain CDR3
DIVMTQSPATLSVTPGDRVSLSCRASQSISDYLHWYQQKSHESPRLLIKYASQSISGIPSRFSGSGSGSDFTLSINSVEPEDVGVYYCQNGHSFPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 6821 - protein, 107 aa, synthetic construct
  REGION 1..107: note = omburtamab light chain V region
DIVMTQSPATLSVTPGDRVSLSCRASQSISDYLHWYQQKSHESPRLLIKYASQSISGIPSRFSGSGSGSDFTLSINSVEPEDVGVYYCQNGHSFPLTFGAGTKLELK

SEQ ID NO: 6822 - protein, 6 aa, synthetic construct
  REGION 1..6: note = omburtamab light chain CDR1
QSISDY

SEQ ID NO: 6823 - skipped

SEQ ID NO: 6824 - protein, 9 aa, synthetic construct
  REGION 1..9: note = omburtamab light chain CDR3
QNGHSFPLT

SEQ ID NO: 6825 - protein, 125 aa, synthetic construct
  REGION 1..125: note = omodenbamab heavy chain V region
EVQLVESGGGLVQPGGSLRLSCAASGFTFSTYGMSWVRQAPGKGLEWVSSITGSGRSTFYADSVKGRFTISRDNSTNTLSLQMNSLRAEDTAVYYCARSPADIVTGYYPWWFDLWGQGTLVTVSS

SEQ ID NO: 6826 - protein, 8 aa, synthetic construct
  REGION 1..8: note = omodenbamab heavy chain CDR1
GFTFSTYG

SEQ ID NO: 6827 - protein, 8 aa, synthetic construct
  REGION 1..8: note = omodenbamab heavy chain CDR2
ITGSGRST

SEQ ID NO: 6828 - protein, 18 aa, synthetic construct
  REGION 1..18: note = omodenbamab heavy chain CDR3
ARSPADIVTGYYPWWFDL

SEQ ID NO: 6829 - protein, 107 aa, synthetic construct
  REGION 1..107: note = omodenbamab light chain V region
DIQMTQSPSSLSASIGDRVTITCRASQSINTYLNWYQQKPGKAPRLLIAGASSLQSGVPSRFSGSGSGTDFTLTISSLQPEDFATYYCQQANSFPLTFGQGTRLEIK

SEQ ID NO: 6830 - protein, 6 aa, synthetic construct
  REGION 1..6: note = omodenbamab light chain CDR1
QSINTY

SEQ ID NO: 6831 - skipped

SEQ ID NO: 6832 - protein, 9 aa, synthetic construct
  REGION 1..9: note = omodenbamab light chain CDR3
QQANSFPLT

SEQ ID NO: 6833 - protein, 116 aa, synthetic construct [sequence omitted]

SEQ ID NO: 6834 - protein, 8 aa, synthetic construct
  REGION 1..8: note = onfekafusp alfa heavy chain CDR1
GFTFSSFS

SEQ ID NO: 6835 - protein, 8 aa, synthetic construct
  REGION 1..8: note = onfekafusp alfa heavy chain CDR2
ISGSSGTT

SEQ ID NO: 6836 - protein, 9 aa, synthetic construct
  REGION 1..9: note = onfekafusp alfa heavy chain CDR3
AKPFPYFDY

SEQ ID NO: 6837 - protein, 108 aa, synthetic construct [sequence omitted]

SEQ ID NO: 6838 - protein, 7 aa, synthetic construct
  REGION 1..7: note = onfekafusp alfa light chain CDR1
QSVSSSF

SEQ ID NO: 6839 - skipped

SEQ ID NO: 6840 - protein, 9 aa, synthetic construct
  REGION 1..9: note = onfekafusp alfa light chain CDR3
QQTGRIPPT

SEQ ID NO: 6841 - protein, 124 aa, synthetic construct
  REGION 1..124: note = ontamalimab heavy chain V region
QVQLVQSGAEVKKPGASVKVSCKASGYTFTSYGINWVRQAPGQGLEWMGWISVYSGNTNYAQKVQGRVTMTADTSTSTAYMDLRSLRSDDTAVYYCAREGSSSSGDYYYGMDVWGQGTTVTVSS

SEQ ID NO: 6842 - protein, 8 aa, synthetic construct
  REGION 1..8: note = ontamalimab heavy chain CDR1
GYTFTSYG

SEQ ID NO: 6843 - protein, 8 aa, synthetic construct
  REGION 1..8: note = ontamalimab heavy chain CDR2
ISVYSGNT

SEQ ID NO: 6844 - protein, 17 aa, synthetic construct
  REGION 1..17: note = ontamalimab heavy chain CDR3
AREGSSSSGDYYYGMDV

SEQ ID NO: 6845 - protein, 112 aa, synthetic construct
  REGION 1..112: note = ontamalimab light chain V region
DIVMTQTPLSLSVTPGQPASISCKSSQSLLHTDGTTYLYWYLQKPGQPPQLLIYEVSNRFSGVPDRFSGSGSGTDFTLKISRVEAEDVGIYYCMQNIQLPWTFGQGTKVEIK

SEQ ID NO: 6846 - protein, 11 aa, synthetic construct
  REGION 1..11: note = ontamalimab light chain CDR1
QSLLHTDGTTY

SEQ ID NO: 6847 - skipped

SEQ ID NO: 6848 - protein, 9 aa, synthetic construct
  REGION 1..9: note = ontamalimab light chain CDR3
MQNIQLPWT

SEQ ID NO: 6849 - protein, 120 aa, synthetic construct
  REGION 1..120: note = onvatilimab heavy chain V region
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARSSYGWSYEFDYWGQGTLVTVSS

SEQ ID NO: 6850 - protein, 7 aa, synthetic construct
  REGION 1..7: note = onvatilimab heavy chain CDR1
GTFSSYA

SEQ ID NO: 6851 - protein, 8 aa, synthetic construct
  REGION 1..8: note = onvatilimab heavy chain CDR2
IIPIFGTA

SEQ ID NO: 6852 - protein, 13 aa, synthetic construct
  REGION 1..13: note = onvatilimab heavy chain CDR3
ARSSYGWSYEFDY

SEQ ID NO: 6853 - protein, 107 aa, synthetic construct
  REGION 1..107: note = onvatilimab light chain V region
DIQMTQSPSSLSASVGDRVTITCRASQSIDTRLNWYQQKPGKAPKLLIYSASSLQSGVPSRFSGSGSGTDFTLTISSLQPEDFATYYCQQSAYNPITFGQGTKVEIK

SEQ ID NO: 6854 - protein, 6 aa, synthetic construct
  REGION 1..6: note = onvatilimab light chain CDR1
QSIDTR

SEQ ID NO: 6855 - skipped

SEQ ID NO: 6856 - protein, 9 aa, synthetic construct
  REGION 1..9: note = onvatilimab light chain CDR3
QQSAYNPIT

SEQ ID NO: 6857 - protein, 118 aa, synthetic construct [sequence omitted]

SEQ ID NO: 6858 - protein, 8 aa, synthetic construct
  REGION 1..8: note = opicinumab heavy chain CDR1
GFTFSAYE

SEQ ID NO: 6859 - protein, 8 aa, synthetic construct
  REGION 1..8: note = opicinumab heavy chain CDR2
IGPSGGFT

SEQ ID NO: 6860 - protein, 11 aa, synthetic construct
  REGION 1..11: note = opicinumab heavy chain CDR3
ATEGDNDAFDI

SEQ ID NO: 6861 - protein, 108 aa, synthetic construct
  REGION 1..108: note = opicinumab light chain V region
DIQMTQSPATLSLSPGERATLSCRASQSVSSYLAWYQQKPGQAPRLLIYDASNRATGIPARFSGSGSGTDFTLTISSLEPEDFAVYYCQQRSNWPMYTFGQGTKLEIK

SEQ ID NO: 6862 - protein, 6 aa, synthetic construct
  REGION 1..6: note = opicinumab light chain CDR1
QSVSSY

SEQ ID NO: 6863 - skipped

SEQ ID NO: 6864 - protein, 10 aa, synthetic construct
  REGION 1..10: note = opicinumab light chain CDR3
QQRSNWPMYT

SEQ ID NO: 6865 - protein, 123 aa, synthetic construct
  REGION 1..123: note = opucolimab heavy chain V region
EVQLVQSGGGLVKPGGSLRLSCAASGFTFSSYTMNWVRQAPGKGLEWVSSISSGSDYLYYADSVKGRFTISRDNAKNSLYLQMNSLRAEDTAVYYCARNELRWYPQAGAFDRWGQGTMVTVSS

SEQ ID NO: 6866 - protein, 8 aa, synthetic construct
  REGION 1..8: note = opucolimab heavy chain CDR1
GFTFSSYT

SEQ ID NO: 6867 - protein, 8 aa, synthetic construct
  REGION 1..8: note = opucolimab heavy chain CDR2
ISSGSDYL

SEQ ID NO: 6868 - protein, 16 aa, synthetic construct
  REGION 1..16: note = opucolimab heavy chain CDR3
ARNELRWYPQAGAFDR

SEQ ID NO: 6869 - protein, 109 aa, synthetic construct
  REGION 1..109: note = opucolimab light chain V region
QSVVTQPPSMSAAPGQRVTISCSGSSSYIESSYVGWYQQLPGTAPRLLIYDDDMRPSGIPDRFSGSKSGTSATLAITGLQTGDEADYYCEIWRSGLGGVFGGGTKLTVL

SEQ ID NO: 6870 - protein, 9 aa, synthetic construct
  REGION 1..9: note = opucolimab light chain CDR1
SSYIESSYV

SEQ ID NO: 6871 - skipped

SEQ ID NO: 6872 - protein, 10 aa, synthetic construct
  REGION 1..10: note = opucolimab light chain CDR3
EIWRSGLGGV

SEQ ID NO: 6873 - protein, 118 aa, synthetic construct
  REGION 1..118: note = ordesekimab heavy chain V region
EVQLVQSGAEVKKPGESLKISCKVSGYFFTTYWIGWVRQMPGKGLEYMGIIYPGDSDTRYSPSFQGQVTISADKSISTAYLQWSSLKASDTAMYYCARGGNWNCFDYWGQGTLVTVSS

SEQ ID NO: 6874 - protein, 8 aa, synthetic construct
  REGION 1..8: note = ordesekimab heavy chain CDR1
GYFFTTYW

SEQ ID NO: 6875 - protein, 8 aa, synthetic construct
  REGION 1..8: note = ordesekimab heavy chain CDR2
IYPGDSDT

SEQ ID NO: 6876 - protein, 11 aa, synthetic construct
  REGION 1..11: note = ordesekimab heavy chain CDR3
ARGGNWNCFDY

SEQ ID NO: 6877 - protein, 106 aa, synthetic construct
  REGION 1..106: note = ordesekimab light chain V region
EIVLTQSPGTLSLSPGERATLSCRASQSVSSSYLAWYQQKPGQAPRLLIYGASRRATGIPDRFSGSGSGTDFTLTISRLEPEDFAVYYCQRYGSSHTFGQGTKLEI

SEQ ID NO: 6878 - protein, 7 aa, synthetic construct
  REGION 1..7: note = ordesekimab light chain CDR1
QSVSSSY

SEQ ID NO: 6879 - skipped

SEQ ID NO: 6880 - protein, 8 aa, synthetic construct
  REGION 1..8: note = ordesekimab light chain CDR3
QRYGSSHT

SEQ ID NO: 6881 - protein, 127 aa, synthetic construct
  REGION 1..127: note = ormutivimab heavy chain V region
QVQLVQSGAEVKKPGSSVKVSCKASGGTFNRYTVNWVRQAPGQGLEWMGGIIPIFGTANYAQRFQGRLTITADESTSTAYMELSSLRSDDTAVYFCARENLDNSGTYYYFSGWFDPWGQGTLVTVSS

SEQ ID NO: 6882 - protein, 8 aa, synthetic construct
  REGION 1..8: note = ormutivimab heavy chain CDR1
GGTFNRYT

SEQ ID NO: 6883 - protein, 8 aa, synthetic construct
  REGION 1..8: note = ormutivimab heavy chain CDR2
IIPIFGTA

SEQ ID NO: 6884 - protein, 20 aa, synthetic construct
  REGION 1..20: note = ormutivimab heavy chain CDR3
ARENLDNSGTYYYFSGWFDP

SEQ ID NO: 6885 - protein, 112 aa, synthetic construct
  REGION 1..112: note = ormutivimab light chain V region
QSALTQPRSVSGSPGQSVTISCTGTSSDIGGYNFVSWYQQHPGKAPKLMIYDATKRPSGVPDRFSGSKSGNTASLTISGLQAEDEADYYCCSYAGDYTPGVVFGGGTKLTVL

SEQ ID NO: 6886 - protein, 8 aa, synthetic construct
  REGION 1..8: note = ormutivimab light chain CDR1
SSDIGGYN

SEQ ID NO: 6887 - skipped

SEQ ID NO: 6888 - protein, 12 aa, synthetic construct
  REGION 1..12: note = ormutivimab light chain CDR3
CSYAGDYTPGVV

SEQ ID NO: 6889 - protein, 121 aa, synthetic construct
  REGION 1..121: note = orticumab heavy chain V region
EVQLLESGGGLVQPGGSLRLSCAASGFTFSNAWMSWVRQAPGKGLEWVSSISVGGHRTYYADSVKGRSTISRDNSKNTLYLQMNSLRAEDTAVYYCARIRVGPSGGAFDYWGQGTLVTVSS

SEQ ID NO: 6890 - protein, 8 aa, synthetic construct
  REGION 1..8: note = orticumab heavy chain CDR1
GFTFSNAW

SEQ ID NO: 6891 - protein, 8 aa, synthetic construct
  REGION 1..8: note = orticumab heavy chain CDR2
ISVGGHRT

SEQ ID NO: 6892 - protein, 14 aa, synthetic construct
  REGION 1..14: note = orticumab heavy chain CDR3
ARIRVGPSGGAFDY

SEQ ID NO: 6893 - protein, 110 aa, synthetic construct
  REGION 1..110: note = orticumab light chain V region
QSVLTQPPSASGTPGQRVTISCSGSNTNIGKNYVSWYQQLPGTAPKLLIYANSNRPSGVPDRFSGSKSGTSASLAISGLRSEDEADYYCASWDASLNGWVFGGGTKLTVL

SEQ ID NO: 6894 - protein, 8 aa, synthetic construct
  REGION 1..8: note = orticumab light chain CDR1
NTNIGKNY

SEQ ID NO: 6895 - skipped

SEQ ID NO: 6896 - protein, 7 aa, synthetic construct
  REGION 1..7: note = orticumab light chain CDR3
ASLNGWV

SEQ ID NO: 6897 - protein, 123 aa, synthetic construct
  REGION 1..123: note = orudokimab heavy chain V region
EVQLVETGGGLIQPGGSLRLSCAASGFTFSFYAMSWVRQAPGKGLEWVSAISGSGGSTYYADSVKGRFTISRDNSKNTLYLQMNSLRAEDTAVYYCARTIHGIRAAYDAFIIWGQGTLVTVSS

SEQ ID NO: 6898 - protein, 8 aa, synthetic construct
  REGION 1..8: note = orudokimab heavy chain CDR1
GFTFSFYA

SEQ ID NO: 6899 - protein, 8 aa, synthetic construct
  REGION 1..8: note = orudokimab heavy chain CDR2
ISGSGGST

SEQ ID NO: 6900 - protein, 16 aa, synthetic construct
  REGION 1..16: note = orudokimab heavy chain CDR3
ARTIHGIRAAYDAFII

SEQ ID NO: 6901 - protein, 108 aa, synthetic construct
  REGION 1..108: note = orudokimab light chain V region
EIVLTQSPGTLSLSPGERATLSCRASQSVGINLSWYQQKPGQAPRLLIYGASHRLTGIPDRFSGSGSGTDFTLTISRLEPEDFAVYYCHQYSQPPPFTFGGGTKVEIK

SEQ ID NO: 6902 - protein, 6 aa, synthetic construct
  REGION 1..6: note = orudokimab light chain CDR1
QSVGIN

SEQ ID NO: 6903 - skipped

SEQ ID NO: 6904 - protein, 10 aa, synthetic construct
  REGION 1..10: note = orudokimab light chain CDR3
HQYSQPPPFT

SEQ ID NO: 6905 - protein, 120 aa, synthetic construct
  REGION 1..120: note = osocimab heavy chain V region
EVQLLESGGGLVQPGGSLRLSCAASGFTFSQYGMDWVRQAPGKGLEWVSGIGPSGGSTVYADSVKGRFTISRDNSKNTLYLQMNSLRAEDTAVYYCTRGGPYYYYGMDVWGQGTTVTVSS

SEQ ID NO: 6906 - protein, 7 aa, synthetic construct
  REGION 1..7: note = osocimab heavy chain CDR1
GFTFSQY

SEQ ID NO: 6907 - protein, 9 aa, synthetic construct
  REGION 1..9: note = osocimab heavy chain CDR2
IGPSGGSTV

SEQ ID NO: 6908 - protein, 13 aa, synthetic construct
  REGION 1..13: note = osocimab heavy chain CDR3
TRGGPYYYYGMDV

SEQ ID NO: 6909 - protein, 107 aa, synthetic construct
  REGION 1..107: note = osocimab light chain V region
DIQMTQSPSSLSASVGDRVTITCQASQDISNYLNWYQQKPGKAPKLLIYDASNLETGVPSRFSGSGSGTDFTFTISSLQPEDIATYYCQQADSFPVTFGGGTKVEIK

SEQ ID NO: 6910 - protein, 6 aa, synthetic construct
  REGION 1..6: note = osocimab light chain CDR1
QDISNY

SEQ ID NO: 6911 - skipped

SEQ ID NO: 6912 - protein, 9 aa, synthetic construct
  REGION 1..9: note = osocimab light chain CDR3
QQADSFPVT

SEQ ID NO: 6913 - protein, 117 aa, synthetic construct [sequence omitted]

SEQ ID NO: 6914 - protein, 7 aa, synthetic construct
  REGION 1..7: note = otilimab heavy chain CDR1
GFTFSSY

SEQ ID NO: 6915 - protein, 10 aa, synthetic construct
  REGION 1..10: note = otilimab heavy chain CDR2
IENKYAGGAT

SEQ ID NO: 6916 - protein, 8 aa, synthetic construct
  REGION 1..8: note = otilimab heavy chain CDR3
ARGFGTDF

SEQ ID NO: 6917 - protein, 104 aa, synthetic construct [sequence omitted]

SEQ ID NO: 6918 - protein, 6 aa, synthetic construct
  REGION 1..6: note = otilimab light chain CDR1
SIGKKY

SEQ ID NO: 6919 - skipped

SEQ ID NO: 6920 - protein, 9 aa, synthetic construct
  REGION 1..9: note = otilimab light chain CDR3
SAWGDKGMV

SEQ ID NO: 6921 - protein, 120 aa, synthetic construct
  REGION 1..120: note = oxelumab heavy chain V region
EVQLLESGGGLVQPGGSLRLSCAASGFTFNSYAMSWVRQAPGKGLEWVSIISGSGGFTYYADSVKGRFTISRDNSRTTLYLQMNSLRAEDTAVYYCAKDRLVAPGTFDYWGQGALVTVSS

SEQ ID NO: 6922 - protein, 8 aa, synthetic construct
  REGION 1..8: note = oxelumab heavy chain CDR1
GFTFNSYA

SEQ ID NO: 6923 - protein, 8 aa, synthetic construct
  REGION 1..8: note = oxelumab heavy chain CDR2
ISGSGGFT

SEQ ID NO: 6924 - protein, 13 aa, synthetic construct
  REGION 1..13: note = oxelumab heavy chain CDR3
AKDRLVAPGTFDY

SEQ ID NO: 6925 - protein, 107 aa, synthetic construct
  REGION 1..107: note = oxelumab light chain V region
DIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIK

SEQ ID NO: 6926 - protein, 6 aa, synthetic construct
  REGION 1..6: note = oxelumab light chain CDR1
QGISSW

SEQ ID NO: 6927 - skipped

SEQ ID NO: 6928 - protein, 9 aa, synthetic construct
  REGION 1..9: note = oxelumab light chain CDR3
QQYNSYPYT

SEQ ID NO: 6929 - protein, 116 aa, synthetic construct
  REGION 1..116: note = pacmilimab heavy chain V region
EVQLLESGGGLVQPGGSLRLSCAASGFTFSSYAMSWVRQAPGKGLEWVSSIWRNGIVTVYADSVKGRFTISRDNSKNTLYLQMNSLRAEDTAVYYCAKWSAAFDYWGQGTLVTVSS

SEQ ID NO: 6930 - protein, 8 aa, synthetic construct
  REGION 1..8: note = pacmilimab heavy chain CDR1
GFTFSSYA

SEQ ID NO: 6931 - protein, 8 aa, synthetic construct
  REGION 1..8: note = pacmilimab heavy chain CDR2
IWRNGIVT

SEQ ID NO: 6932 - protein, 9 aa, synthetic construct
  REGION 1..9: note = pacmilimab heavy chain CDR3
AKWSAAFDY

SEQ ID NO: 6933 - protein, 157 aa, synthetic construct
  REGION 1..157: note = pacmilimab light chain V region
QGQSGSGIALCPSHFCQLPQTGGGSSGGSGGSGGISSGLLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIK

SEQ ID NO: 6934 - protein, 6 aa, synthetic construct
  REGION 1..6: note = pacmilimab light chain CDR1
QSISSY

SEQ ID NO: 6935 - skipped

SEQ ID NO: 6936 - protein, 9 aa, synthetic construct
  REGION 1..9: note = pacmilimab light chain CDR3
QQDNGYPST

SEQ ID NO: 6937 - protein, 120 aa, synthetic construct
  REGION 1..120: note = pamrevlumab heavy chain V region
EGQLVQSGGGLVHPGGSLRLSCAGSGFTFSSYGMHWVRQAPGKGLEWVSGIGTGGGTYSTDSVKGRFTISRDNAKNSLYLQMNSLRAEDMAVYYCARGDYYGSGSFFDCWGQGTLVTVSS

SEQ ID NO: 6938 - protein, 7 aa, synthetic construct
  REGION 1..7: note = pamrevlumab heavy chain CDR1
GFTFSSY

SEQ ID NO: 6939 - protein, 10 aa, synthetic construct
  REGION 1..10: note = pamrevlumab heavy chain CDR2
IGTGGGTYST

SEQ ID NO: 6940 - protein, 14 aa, synthetic construct
  REGION 1..14: note = pamrevlumab heavy chain CDR3
ARGDYYGSGSFFDC

SEQ ID NO: 6941 - protein, 107 aa, synthetic construct
  REGION 1..107: note = pamrevlumab light chain V region
DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGQGTKLEIK

SEQ ID NO: 6942 - protein, 6 aa, synthetic construct
  REGION 1..6: note = pamrevlumab light chain CDR1
QGISSW

SEQ ID NO: 6943 - skipped

SEQ ID NO: 6944 - protein, 9 aa, synthetic construct
  REGION 1..9: note = pamrevlumab light chain CDR3
QQYNSYPPT

SEQ ID NO: 6945 - protein, 116 aa, synthetic construct
  REGION 1..116: note = panobacumab heavy chain V region
EEQVVESGGGFVQPGGSLRLSCAASGFTFSPYWMHWVRQAPGKGLVWVSRINSDGSTYYADSVKGRFTISRDNARNTLYLQMNSLRAEDTAVYYCARDRYYGPEMWGQGTMVTVSS

SEQ ID NO: 6946 - protein, 9 aa, synthetic construct
  REGION 1..9: note = panobacumab heavy chain CDR1
GFTFSPYWM

SEQ ID NO: 6947 - protein, 7 aa, synthetic construct
  REGION 1..7: note = panobacumab heavy chain CDR2
INSDGST

SEQ ID NO: 6948 - protein, 10 aa, synthetic construct
  REGION 1..10: note = panobacumab heavy chain CDR3
ARDRYYGPEM

SEQ ID NO: 6949 - protein, 112 aa, synthetic construct
  REGION 1..112: note = panobacumab light chain V region
DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPLTFGGGTKVEIK

SEQ ID NO: 6950 - protein, 11 aa, synthetic construct
  REGION 1..11: note = panobacumab light chain CDR1
QSLVYSDGNTY

SEQ ID NO: 6951 - skipped

SEQ ID NO: 6952 - protein, 9 aa, synthetic construct
  REGION 1..9: note = panobacumab light chain CDR3
MQGTHWPLT

SEQ ID NO: 6953 - protein, 117 aa, synthetic construct [sequence omitted]

SEQ ID NO: 6954 - protein, 8 aa, synthetic construct
  REGION 1..8: note = patritumab heavy chain CDR1
GGSFSGYY

SEQ ID NO: 6955 - protein, 7 aa, synthetic construct
  REGION 1..7: note = patritumab heavy chain CDR2
INHSGST

SEQ ID NO: 6956 - protein, 11 aa, synthetic construct
  REGION 1..11: note = patritumab heavy chain CDR3
ARDKWTWYFDL

SEQ ID NO: 6957 - protein, 113 aa, synthetic construct [sequence omitted]

SEQ ID NO: 6958 - protein, 12 aa, synthetic construct
  REGION 1..12: note = patritumab light chain CDR1
QSVLYSSSNRNY

SEQ ID NO: 6959 - skipped

SEQ ID NO: 6960 - protein, 9 aa, synthetic construct
  REGION 1..9: note = patritumab light chain CDR3
QQYYSTPRT

SEQ ID NO: 6961 - protein, 117 aa, synthetic construct [sequence omitted]

SEQ ID NO: 6962 - protein, 8 aa, synthetic construct
  REGION 1..8: note = patritumab deruxtecan heavy chain CDR1
GGSFSGYY

SEQ ID NO: 6963 - protein, 7 aa, synthetic construct
  REGION 1..7: note = patritumab deruxtecan heavy chain CDR2
INHSGST

SEQ ID NO: 6964 - protein, 11 aa, synthetic construct
  REGION 1..11: note = patritumab deruxtecan heavy chain CDR3
ARDKWTWYFDL

SEQ ID NO: 6965 - protein, 113 aa, synthetic construct [sequence omitted]

SEQ ID NO: 6966 - protein, 12 aa, synthetic construct
  REGION 1..12: note = patritumab deruxtecan light chain CDR1
QSVLYSSSNRNY

SEQ ID NO: 6967 - skipped

SEQ ID NO: 6968 - protein, 9 aa, synthetic construct
  REGION 1..9: note = patritumab deruxtecan light chain CDR3
QQYYSTPRT

SEQ ID NO: 6969 - protein, 123 aa, synthetic construct
  REGION 1..123: note = pelgifatamab corixetan heavy chain V region
QVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSS

SEQ ID NO: 6970 - protein, 7 aa, synthetic construct
  REGION 1..7: note = pelgifatamab corixetan heavy chain CDR1
GFAFSRY

SEQ ID NO: 6971 - protein, 8 aa, synthetic construct
  REGION 1..8: note = pelgifatamab corixetan heavy chain CDR2
IWYDGSNK

SEQ ID NO: 6972 - protein, 16 aa, synthetic construct
  REGION 1..16: note = pelgifatamab corixetan heavy chain CDR3
ARGGDFLYYYYYGMDV

SEQ ID NO: 6973 - protein, 107 aa, synthetic construct
  REGION 1..107: note = pelgifatamab corixetan light chain V region
DIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIK

SEQ ID NO: 6974 - protein, 6 aa, synthetic construct
  REGION 1..6: note = pelgifatamab corixetan light chain CDR1
QGISNY

SEQ ID NO: 6975 - skipped

SEQ ID NO: 6976 - protein, 9 aa, synthetic construct
  REGION 1..9: note = pelgifatamab corixetan light chain CDR3
QNYNSAPFT

SEQ ID NO: 6977 - protein, 120 aa, synthetic construct [sequence omitted]

SEQ ID NO: 6978 - protein, 8 aa, synthetic construct
  REGION 1..8: note = pembrolizumab heavy chain CDR1
GYTFTNYY

SEQ ID NO: 6979 - protein, 8 aa, synthetic construct
  REGION 1..8: note = pembrolizumab heavy chain CDR2
INPSNGGT

SEQ ID NO: 6980 - protein, 13 aa, synthetic construct
  REGION 1..13: note = pembrolizumab heavy chain CDR3
ARRDYRFDMGFDY

SEQ ID NO: 6981 - protein, 111 aa, synthetic construct [sequence omitted]

SEQ ID NO: 6982 - protein, 10 aa, synthetic construct
  REGION 1..10: note = pembrolizumab light chain CDR1
KGVSTSGYSY

SEQ ID NO: 6983 - skipped

SEQ ID NO: 6984 - protein, 9 aa, synthetic construct
  REGION 1..9: note = pembrolizumab light chain CDR3
QHSRDLPLT

SEQ ID NO: 6985 - protein, 119 aa, synthetic construct [sequence omitted]

SEQ ID NO: 6986 - protein, 8 aa, synthetic construct
  REGION 1..8: note = pertuzumab heavy chain CDR1
GFTFTDYT

SEQ ID NO: 6987 - protein, 8 aa, synthetic construct
  REGION 1..8: note = pertuzumab heavy chain CDR2
VNPNSGGS

SEQ ID NO: 6988 - protein, 12 aa, synthetic construct
  REGION 1..12: note = pertuzumab heavy chain CDR3
ARNLGPSFYFDY

SEQ ID NO: 6989 - protein, 107 aa, synthetic construct [sequence omitted]

SEQ ID NO: 6990 - protein, 6 aa, synthetic construct
  REGION 1..6: note = pertuzumab light chain CDR1
QDVSIG

SEQ ID NO: 6991 - skipped

SEQ ID NO: 6992 - protein, 9 aa, synthetic construct
  REGION 1..9: note = pertuzumab light chain CDR3
QQYYIYPYT

SEQ ID NO: 6993 - protein, 120 aa, synthetic construct
  REGION 1..120: note = petosemtamab heavy chain V region
QVQLVQSGSELKKPGASVKISCKASGYDFTNYAMNWVRQAPGHGLEWMGWINANTGDPTYAQGFTGRFVFSLDTSVSTAYLQISSLKAEDSAVYYCTRERFLEWLHFDYWGQGTLVTVSS

SEQ ID NO: 6994 - protein, 8 aa, synthetic construct
  REGION 1..8: note = petosemtamab heavy chain CDR1
GYDFTNYA

SEQ ID NO: 6995 - protein, 8 aa, synthetic construct
  REGION 1..8: note = petosemtamab heavy chain CDR2
INANTGDP

SEQ ID NO: 6996 - protein, 13 aa, synthetic construct
  REGION 1..13: note = petosemtamab heavy chain CDR3
TRERFLEWLHFDY

SEQ ID NO: 6997 - protein, 107 aa, synthetic construct
  REGION 1..107: note = petosemtamab light chain V region
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIK

SEQ ID NO: 6998 - protein, 6 aa, synthetic construct
  REGION 1..6: note = petosemtamab light chain CDR1
QSISSY

SEQ ID NO: 6999 - skipped

SEQ ID NO: 7000 - protein, 9 aa, synthetic construct
  REGION 1..9: note = petosemtamab light chain CDR3
QQSYSTPPT

SEQ ID NO: 7001 - protein, 118 aa, synthetic construct
  REGION 1..118: note = pimivalimab heavy chain V region
QVQLVQSGAEVKKPGASVKVSCKASGYTFPSYYMHWVRQAPGQGLEWMGIINPEGGSTAYAQKFQGRVTMTRDTSTSTVYMELSSLRSEDTAVYYCARGGTYYDYTYWGQGTLVTVSS

SEQ ID NO: 7002 - protein, 8 aa, synthetic construct
  REGION 1..8: note = pimivalimab heavy chain CDR1
GYTFPSYY

SEQ ID NO: 7003 - protein, 8 aa, synthetic construct
  REGION 1..8: note = pimivalimab heavy chain CDR2
INPEGGST

SEQ ID NO: 7004 - protein, 11 aa, synthetic construct
  REGION 1..11: note = pimivalimab heavy chain CDR3
ARGGTYYDYTY

SEQ ID NO: 7005 - protein, 107 aa, synthetic construct
  REGION 1..107: note = pimivalimab light chain V region
DIQMTQSPSTLSASVGDRVTITCRASQSISSWLAWYQQKPGKAPKLLIYEASSLESGVPSRFSGSGSGTEFTLTISSLQPDDFATYYCQQYNSFPPTFGGGTKVEIK

SEQ ID NO: 7006 - protein, 6 aa, synthetic construct
  REGION 1..6: note = pimivalimab light chain CDR1
QSISSW

SEQ ID NO: 7007 - skipped

SEQ ID NO: 7008 - protein, 9 aa, synthetic construct
  REGION 1..9: note = pimivalimab light chain CDR3
QQYNSFPPT

SEQ ID NO: 7009 - protein, 117 aa, synthetic construct [sequence omitted]

SEQ ID NO: 7010 - protein, 8 aa, synthetic construct
  REGION 1..8: note = polatuzumab vedotin heavy chain CDR1
GYTFSSYW

SEQ ID NO: 7011 - protein, 8 aa, synthetic construct
  REGION 1..8: note = polatuzumab vedotin heavy chain CDR2
ILPGGGDT

SEQ ID NO: 7012 - protein, 10 aa, synthetic construct
  REGION 1..10: note = polatuzumab vedotin heavy chain CDR3
TRRVPIRLDY

SEQ ID NO: 7013 - protein, 111 aa, synthetic construct [sequence omitted]

SEQ ID NO: 7014 - protein, 10 aa, synthetic construct
  REGION 1..10: note = polatuzumab vedotin light chain CDR1
QSVDYEGDSF

SEQ ID NO: 7015 - skipped

SEQ ID NO: 7016 - protein, 9 aa, synthetic construct
  REGION 1..9: note = polatuzumab vedotin light chain CDR3
QQSNEDPLT

SEQ ID NO: 7017 - protein, 120 aa, synthetic construct
  REGION 1..120: note = ponsegromab heavy chain V region
QVQLVQSGAEVKKPGSSVKVSCKASGYTFSSYNIDWVRQAPGQGLEWMGGINPIFGTAFYNQKFQGRVTITADESTSTAYMELSSLRSEDTAVYYCAREAITTVGAMDHWGQGTLVTVSS

SEQ ID NO: 7018 - protein, 7 aa, synthetic construct
  REGION 1..7: note = ponsegromab heavy chain CDR1
GYTFSSY

SEQ ID NO: 7019 - protein, 8 aa, synthetic construct
  REGION 1..8: note = ponsegromab heavy chain CDR2
INPIFGTA

SEQ ID NO: 7020 - protein, 13 aa, synthetic construct
  REGION 1..13: note = ponsegromab heavy chain CDR3
AREAITTVGAMDH

SEQ ID NO: 7021 - protein, 107 aa, synthetic construct
  REGION 1..107: note = ponsegromab light chain V region
EIVLTQSPATLSLSPGERATLSCRTSQSVHNYLAWYQQKPGQAPRLLIYDASTRADGIPARFSGSGSGTDFTLTISSLEPEDFAVYYCQQFWSWPWTFGQGTKVEIK

SEQ ID NO: 7022 - protein, 6 aa, synthetic construct
  REGION 1..6: note = ponsegromab light chain CDR1
QSVHNY

SEQ ID NO: 7023 - skipped

SEQ ID NO: 7024 - protein, 9 aa, synthetic construct
  REGION 1..9: note = ponsegromab light chain CDR3
QQFWSWPWT

SEQ ID NO: 7025 - protein, 120 aa, synthetic construct
  REGION 1..120: note = pozelimab heavy chain V region
QVQLQESGPGLVKPSETLSLTCTVSGDSVSSSYWTWIRQPPGKGLEWIGYIYYSGSSNYNPSLKSRATISVDTSKNQFSLKLSSVTAADTAVYYCAREGNVDTTMIFDYWGQGTLVTVSS

SEQ ID NO: 7026 - protein, 8 aa, synthetic construct
  REGION 1..8: note = pozelimab heavy chain CDR1
GDSVSSSY

SEQ ID NO: 7027 - protein, 7 aa, synthetic construct
  REGION 1..7: note = pozelimab heavy chain CDR2
IYYSGSS

SEQ ID NO: 7028 - protein, 14 aa, synthetic construct
  REGION 1..14: note = pozelimab heavy chain CDR3
AREGNVDTTMIFDY

SEQ ID NO: 7029 - protein, 107 aa, synthetic construct
  REGION 1..107: note = pozelimab light chain V region
AIQMTQSPSSLSASVGDRVTITCRASQGIRNDLGWYQQKPGKAPKLLIYAASSLQSGVPSRFAGRGSGTDFTLTISSLQPEDFATYYCLQDFNYPWTFGQGTKVEIK

SEQ ID NO: 7030 - protein, 6 aa, synthetic construct
  REGION 1..6: note = pozelimab light chain CDR1
QGIRND

SEQ ID NO: 7031 - skipped

SEQ ID NO: 7032 - protein, 9 aa, synthetic construct
  REGION 1..9: note = pozelimab light chain CDR3
LQDFNYPWT

SEQ ID NO: 7033 - protein, 121 aa, synthetic construct
  REGION 1..121: note = prezalumab heavy chain V region
EVQLVESGGGLVQPGGSLRLSCAASGFTFSSYWMSWVRQAPGKGLEWVAYIKQDGNEKYYVDSVKGRFTISRDNAKNSLYLQMNSLRAEDTAVYYCAREGILWFGDLPTFWGQGTLVTVSS

SEQ ID NO: 7034 - protein, 7 aa, synthetic construct
  REGION 1..7: note = prezalumab heavy chain CDR1
GFTFSSY

SEQ ID NO: 7035 - protein, 8 aa, synthetic construct
  REGION 1..8: note = prezalumab heavy chain CDR2
IKQDGNEK

SEQ ID NO: 7036 - protein, 14 aa, synthetic construct
  REGION 1..14: note = prezalumab heavy chain CDR3
AREGILWFGDLPTF

SEQ ID NO: 7037 - protein, 107 aa, synthetic construct
  REGION 1..107: note = prezalumab light chain V region
DIQMTQSPSSLSASVGDRVTITCRASQGISNWLAWYQQKPEKAPKSLIYAASSLQSGVPSRFSGSGSGTDFTLTISSLQPEDFATYYCQQYDSYPRTFGQGTKVEIK

SEQ ID NO: 7038 - protein, 6 aa, synthetic construct
  REGION 1..6: note = prezalumab light chain CDR1
QGISNW

SEQ ID NO: 7039 - skipped

SEQ ID NO: 7040 - protein, 9 aa, synthetic construct
  REGION 1..9: note = prezalumab light chain CDR3
QQYDSYPRT

SEQ ID NO: 7041 - protein, 129 aa, synthetic construct
  REGION 1..129: note = prolgolimab heavy chain V region
QVQLVQSGGGLVQPGGSLRLSCAASGFTFSSYWMYWVRQVPGKGLEWVSAIDTGGGRTYYADSVKGRFAISRVNAKNTMYLQMNSLRAEDTAVYYCARDEGGGTGWGVLKDWPYGLDAWGQGTLVTVSS

SEQ ID NO: 7042 - protein, 7 aa, synthetic construct
  REGION 1..7: note = prolgolimab heavy chain CDR1
GFTFSSY

SEQ ID NO: 7043 - protein, 8 aa, synthetic construct
  REGION 1..8: note = prolgolimab heavy chain CDR2
IDTGGGRT

SEQ ID NO: 7044 - protein, 22 aa, synthetic construct
  REGION 1..22: note = prolgolimab heavy chain CDR3
ARDEGGGTGWGVLKDWPYGLDA

SEQ ID NO: 7045 - protein, 106 aa, synthetic construct
  REGION 1..106: note = prolgolimab light chain V region
QPVLTQPLSVSVALGQTARITCGGNNIGSKNVHWYQQKPGQAPVLVIYRDSNRPSGIPERFSGSNSGNTATLTISRAQAGDEADYYCQVWDSSTAVFGTGTKLTVL

SEQ ID NO: 7046 - protein, 6 aa, synthetic construct
  REGION 1..6: note = prolgolimab light chain CDR1
NIGSKN

SEQ ID NO: 7047 - skipped

SEQ ID NO: 7048 - protein, 9 aa, synthetic construct
  REGION 1..9: note = prolgolimab light chain CDR3
QVWDSSTAV

SEQ ID NO: 7049 - protein, 116 aa, synthetic construct [sequence omitted]

SEQ ID NO: 7050 - protein, 8 aa, synthetic construct
  REGION 1..8: note = pulocimab heavy chain CDR1
GFTFSSYS

SEQ ID NO: 7051 - protein, 8 aa, synthetic construct
  REGION 1..8: note = pulocimab heavy chain CDR2
ISSSSSYI

SEQ ID NO: 7052 - protein, 9 aa, synthetic construct
  REGION 1..9: note = pulocimab heavy chain CDR3
ARVTDAFDI

SEQ ID NO: 7053 - protein, 107 aa, synthetic construct
  REGION 1..107: note = pulocimab light chain V region
DIQMTQSPSSVSASIGDRVTITCRASQGLDNWLGWYQQKPGKAPKLLIYDASNLDTGVPSRFSGSGSGTYFTLTISSLQAEDFAVYFCQQAKAFPPTFGGGTKVDIK

SEQ ID NO: 7054 - protein, 6 aa, synthetic construct
  REGION 1..6: note = pulocimab light chain CDR1
QGLDNW

SEQ ID NO: 7055 - skipped

SEQ ID NO: 7056 - protein, 9 aa, synthetic construct
  REGION 1..9: note = pulocimab light chain CDR3
QQAKAFPPT

SEQ ID NO: 7057 - protein, 122 aa, synthetic construct
  REGION 1..122: note = quisovalimab heavy chain V region
QVQLQQWGAGLLKPSETLSLTCAVYGGSFSGYNWHWIRQPPGKGLEWIGEITHSGSTNYNPSLKSRVTISVDTSKNQFSLKLSSVTAADTAVYYCVREIAVAGTGYYGMDVWGQGTTVTVSS

SEQ ID NO: 7058 - protein, 8 aa, synthetic construct
  REGION 1..8: note = quisovalimab heavy chain CDR1
GGSFSGYN

SEQ ID NO: 7059 - protein, 7 aa, synthetic construct
  REGION 1..7: note = quisovalimab heavy chain CDR2
ITHSGST

SEQ ID NO: 7060 - protein, 16 aa, synthetic construct
  REGION 1..16: note = quisovalimab heavy chain CDR3
VREIAVAGTGYYGMDV

SEQ ID NO: 7061 - protein, 107 aa, synthetic construct
  REGION 1..107: note = quisovalimab light chain V region
AIQLTQSPSSLSASVGDRVTITCRASQGINSAFAWYQQKPGKAPKLLIYDASSLESGVPSRFSGSGSGTDFTLTISSLQPEDFATYYCQQFNSYPLTFGGGTKVEIK

SEQ ID NO: 7062 - protein, 6 aa, synthetic construct
  REGION 1..6: note = quisovalimab light chain CDR1
QGINSA

SEQ ID NO: 7063 - skipped

SEQ ID NO: 7064 - protein, 9 aa, synthetic construct
  REGION 1..9: note = quisovalimab light chain CDR3
QQFNSYPLT

SEQ ID NO: 7065 - protein, 121 aa, synthetic construct
  REGION 1..121: note = racotumomab heavy chain V region
QVQLQQSGAELVKPGASVKLSCKASGYTFTSYDINWVRQRPEQGLEWIGWIFPGDGSTKYNEKFKGKATLTTDKSSSTAYMQLSRLTSEDSAVYFCAREDYYDNSYYFDYWGQGTTLTVSS

SEQ ID NO: 7066 - protein, 8 aa, synthetic construct
  REGION 1..8: note = racotumomab heavy chain CDR1
GYTFTSYD

SEQ ID NO: 7067 - protein, 8 aa, synthetic construct
  REGION 1..8: note = racotumomab heavy chain CDR2
IFPGDGST

SEQ ID NO: 7068 - protein, 14 aa, synthetic construct
  REGION 1..14: note = racotumomab heavy chain CDR3
AREDYYDNSYYFDY

SEQ ID NO: 7069 - protein, 107 aa, synthetic construct
  REGION 1..107: note = racotumomab light chain V region
DIQMTQTTSSLSASLGDRVTISCRASQDISNYLNWYQQKPDGTVKLLIYYTSRLHSGVPSRFSGSGSGTDYSLTISNLEQEDIATYFCQQGNTLPWTFGGGTKLEIK

SEQ ID NO: 7070 - protein, 6 aa, synthetic construct
  REGION 1..6: note = racotumomab light chain CDR1
QDISNY

SEQ ID NO: 7071 - skipped

SEQ ID NO: 7072 - protein, 9 aa, synthetic construct
  REGION 1..9: note = racotumomab light chain CDR3
QQGNTLPWT

SEQ ID NO: 7073 - protein, 116 aa, synthetic construct [sequence omitted]

SEQ ID NO: 7074 - protein, 8 aa, synthetic construct
  REGION 1..8: note = radretumab heavy chain CDR1
GFTFSSFS

SEQ ID NO: 7075 - protein, 8 aa, synthetic construct
  REGION 1..8: note = radretumab heavy chain CDR2
ISGSSGTT

SEQ ID NO: 7076 - protein, 9 aa, synthetic construct
  REGION 1..9: note = radretumab heavy chain CDR3
AKPFPYFDY

SEQ ID NO: 7077 - protein, 108 aa, synthetic construct [sequence omitted]

SEQ ID NO: 7078 - protein, 7 aa, synthetic construct
  REGION 1..7: note = radretumab light chain CDR1
QSVSSSF

SEQ ID NO: 7079 - skipped

SEQ ID NO: 7080 - protein, 9 aa, synthetic construct
  REGION 1..9: note = radretumab light chain CDR3
QQTGRIPPT

SEQ ID NO: 7081 - protein, 127 aa, synthetic construct; identical to SEQ ID NO: 6881
  REGION 1..127: note = rafivirumab heavy chain V region

SEQ ID NO: 7082 - protein, 7 aa, synthetic construct
  REGION 1..7: note = rafivirumab heavy chain CDR1
GGTFNRY

SEQ ID NO: 7083 - protein, 8 aa, synthetic construct
  REGION 1..8: note = rafivirumab heavy chain CDR2
IIPIFGTA

SEQ ID NO: 7084 - protein, 20 aa, synthetic construct
  REGION 1..20: note = rafivirumab heavy chain CDR3
ARENLDNSGTYYYFSGWFDP

SEQ ID NO: 7085 - protein, 112 aa, synthetic construct; identical to SEQ ID NO: 6885
  REGION 1..112: note = rafivirumab light chain V region

SEQ ID NO: 7086 - protein, 9 aa, synthetic construct
  REGION 1..9: note = rafivirumab light chain CDR1
SSDIGGYNF

SEQ ID NO: 7087 - skipped

SEQ ID NO: 7088 - protein, 12 aa, synthetic construct
  REGION 1..12: note = rafivirumab light chain CDR3
CSYAGDYTPGVV

SEQ ID NO: 7089 - protein, 115 aa, synthetic construct
  REGION 1..115: note = ramucirumab heavy chain V region
VQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARVTDAFDIWGQGTMVTVSS

SEQ ID NO: 7090 - protein, 8 aa, synthetic construct
  REGION 1..8: note = ramucirumab heavy chain CDR1
GFTFSSYS

SEQ ID NO: 7091 - protein, 8 aa, synthetic construct
  REGION 1..8: note = ramucirumab heavy chain CDR2
ISSSSSYI

SEQ ID NO: 7092 - protein, 9 aa, synthetic construct
  REGION 1..9: note = ramucirumab heavy chain CDR3
ARVTDAFDI

SEQ ID NO: 7093 - protein, 107 aa, synthetic construct [sequence omitted]

SEQ ID NO: 7094 - protein, 6 aa, synthetic construct
  REGION 1..6: note = ramucirumab light chain CDR1
QGIDNW

SEQ ID NO: 7095 - skipped

SEQ ID NO: 7096 - protein, 9 aa, synthetic construct
  REGION 1..9: note = ramucirumab light chain CDR3
QQAKAFPPT

SEQ ID NO: 7097 - protein, 123 aa, synthetic construct [sequence omitted]

SEQ ID NO: 7098 - protein, 8 aa, synthetic construct
  REGION 1..8: note = ranibizumab heavy chain CDR1
GYDFTHYG

SEQ ID NO: 7099 - protein, 8 aa, synthetic construct
  REGION 1..8: note = ranibizumab heavy chain CDR2
INTYTGEP

SEQ ID NO: 7100 - protein, 16 aa, synthetic construct
  REGION 1..16: note = ranibizumab heavy chain CDR3
AKYPYYYGTSHWYFDV

SEQ ID NO: 7101 - protein, 107 aa, synthetic construct [sequence omitted]

SEQ ID NO: 7102 - protein, 6 aa, synthetic construct
  REGION 1..6: note = ranibizumab light chain CDR1
QDISNY

SEQ ID NO: 7103 - skipped

SEQ ID NO: 7104 - protein, 9 aa, synthetic construct
  REGION 1..9: note = ranibizumab light chain CDR3
QQYSTVPWT

SEQ ID NO: 7105 - protein, 122 aa, synthetic construct [sequence omitted]

SEQ ID NO: 7106 - protein, 7 aa, synthetic construct
  REGION 1..7: note = ravulizumab heavy chain CDR1
GHIFSNY

SEQ ID NO: 7107 - protein, 8 aa, synthetic construct
  REGION 1..8: note = ravulizumab heavy chain CDR2
ILPGSGHT

SEQ ID NO: 7108 - protein, 15 aa, synthetic construct
  REGION 1..15: note = ravulizumab heavy chain CDR3
ARYFFGSSPNWYFDV

SEQ ID NO: 7109 - protein, 107 aa, synthetic construct [sequence omitted]

SEQ ID NO: 7110 - protein, 6 aa, synthetic construct
  REGION 1..6: note = ravulizumab light chain CDR1
ENIYGA

SEQ ID NO: 7111 - skipped

SEQ ID NO: 7112 - protein, 9 aa, synthetic construct
  REGION 1..9: note = ravulizumab light chain CDR3
QNVLNTPLT

SEQ ID NO: 7113 - protein, 128 aa, synthetic construct; identical to SEQ ID NO: 460
  REGION 1..128: note = regdanvimab heavy chain V region

SEQ ID NO: 7114 - protein, 10 aa, synthetic construct
  REGION 1..10: note = regdanvimab heavy chain CDR1
GFSLSTSGVG

SEQ ID NO: 7115 - protein, 7 aa, synthetic construct
  REGION 1..7: note = regdanvimab heavy chain CDR2
IDWDDNK

SEQ ID NO: 7116 - protein, 20 aa, synthetic construct
  REGION 1..20: note = regdanvimab heavy chain CDR3
ARIPGFLRYRNRYYYYGMDV

SEQ ID NO: 7117 - protein, 110 aa, synthetic construct; identical to SEQ ID NO: 459
  REGION 1..110: note = regdanvimab light chain V region

SEQ ID NO: 7118 - protein, 8 aa, synthetic construct
  REGION 1..8: note = regdanvimab light chain CDR1
SSNIGNNY

SEQ ID NO: 7119 - skipped

SEQ ID NO: 7120 - protein, 11 aa, synthetic construct
  REGION 1..11: note = regdanvimab light chain CDR3
GTWDSSLSAGV

SEQ ID NO: 7121 - protein, 120 aa, synthetic construct
  REGION 1..120: note = relatlimab heavy chain V region
QVQLQQWGAGLLKPSETLSLTCAVYGGSFSDYYWNWIRQPPGKGLEWIGEINHRGSTNSNPSLKSRVTLSLDTSKNQFSLKLRSVTAADTAVYYCAFGYSDYEYNWFDPWGQGTLVTVSS

SEQ ID NO: 7122 - protein, 8 aa, synthetic construct
  REGION 1..8: note = relatlimab heavy chain CDR1
GGSFSDYY

SEQ ID NO: 7123 - protein, 7 aa, synthetic construct
  REGION 1..7: note = relatlimab heavy chain CDR2
INHRGST

SEQ ID NO: 7124 - protein, 14 aa, synthetic construct
  REGION 1..14: note = relatlimab heavy chain CDR3
AFGYSDYEYNWFDP

SEQ ID NO: 7125 - protein, 107 aa, synthetic construct
  REGION 1..107: note = relatlimab light chain V region
EIVLTQSPATLSLSPGERATLSCRASQSISSYLAWYQQKPGQAPRLLIYDASNRATGIPARFSGSGSGTDFTLTISSLEPEDFAVYYCQQRSNWPLTFGQGTNLEIK

SEQ ID NO: 7126 - protein, 6 aa, synthetic construct
  REGION 1..6: note = relatlimab light chain CDR1
QSISSY

SEQ ID NO: 7127 - skipped

SEQ ID NO: 7128 - protein, 9 aa, synthetic construct
  REGION 1..9: note = relatlimab light chain CDR3
QQRSNWPLT

SEQ ID NO: 7129 - protein, 121 aa, synthetic construct [sequence omitted]

SEQ ID NO: 7130 - protein, 8 aa, synthetic construct
  REGION 1..8: note = remtolumab heavy chain CDR1
GFTFDDYA

SEQ ID NO: 7131 - protein, 8 aa, synthetic construct
  REGION 1..8: note = remtolumab heavy chain CDR2
ITWNSGHI

SEQ ID NO: 7132 - protein, 14 aa, synthetic construct
  REGION 1..14: note = remtolumab heavy chain CDR3
AKVSYLSTASSLDY

SEQ ID NO: 7133 - protein, 107 aa, synthetic construct [sequence omitted]

SEQ ID NO: 7134 - protein, 6 aa, synthetic construct
  REGION 1..6: note = remtolumab light chain CDR1
QGIRNY

SEQ ID NO: 7135 - skipped

SEQ ID NO: 7136 - protein, 9 aa, synthetic construct
  REGION 1..9: note = remtolumab light chain CDR3
HQTDSLPYT

SEQ ID NO: 7137 - protein, 119 aa, synthetic construct; identical to SEQ ID NO: 5177
  REGION 1..119: note = retlirafusp alfa heavy chain V region

SEQ ID NO: 7138 - protein, 8 aa, synthetic construct
  REGION 1..8: note = retlirafusp alfa heavy chain CDR1
GYTFTSYW

SEQ ID NO: 7139 - protein, 8 aa, synthetic construct
  REGION 1..8: note = retlirafusp alfa heavy chain CDR2
IGPNSGFT

SEQ ID NO: 7140 - protein, 12 aa, synthetic construct
  REGION 1..12: note = retlirafusp alfa heavy chain CDR3
ARGGSSYDYFDY

SEQ ID NO: 7141 - protein, 111 aa, synthetic construct; identical to SEQ ID NO: 5181
  REGION 1..111: note = retlirafusp alfa light chain V region

SEQ ID NO: 7142 - protein, 10 aa, synthetic construct
  REGION 1..10: note = retlirafusp alfa light chain CDR1
ESVSIHGTHL

SEQ ID NO: 7143 - skipped

SEQ ID NO: 7144 - protein, 9 aa, synthetic construct
  REGION 1..9: note = retlirafusp alfa light chain CDR3
QQSFEDPLT

SEQ ID NO: 7145 - protein, 120 aa, synthetic construct
  REGION 1..120: note = rilotumumab heavy chain V region
QVQLQESGPGLVKPSETLSLTCTVSGGSISIYYWSWIRQPPGKGLEWIGYVYYSGSTNYNPSLKSRVTISVDTSKNQFSLKLNSVTAADTAVYYCARGGYDFWSGYFDYWGQGTLVTVSS

SEQ ID NO: 7146 - protein, 8 aa, synthetic construct
  REGION 1..8: note = rilotumumab heavy chain CDR1
GGSISIYY

SEQ ID NO: 7147 - protein, 7 aa, synthetic construct
  REGION 1..7: note = rilotumumab heavy chain CDR2
VYYSGST

SEQ ID NO: 7148 - protein, 14 aa, synthetic construct
  REGION 1..14: note = rilotumumab heavy chain CDR3
ARGGYDFWSGYFDY

SEQ ID NO: 7149 - protein, 108 aa, synthetic construct
  REGION 1..108: note = rilotumumab light chain V region
EIVMTQSPATLSVSPGERATLSCRASQSVDSNLAWYRQKPGQAPRLLIYGASTRATGIPARFSGSGSGTEFTLTISSLQSEDFAVYYCQQYINWPPITFGQGTRLEIK

SEQ ID NO: 7150 - protein, 6 aa, synthetic construct
  REGION 1..6: note = rilotumumab light chain CDR1
QSVDSN

SEQ ID NO: 7151 - skipped

SEQ ID NO: 7152 - protein, 10 aa, synthetic construct
  REGION 1..10: note = rilotumumab light chain CDR3
QQYINWPPIT

SEQ ID NO: 7153 - protein, 122 aa, synthetic construct
  REGION 1..122: note = rinucumab heavy chain V region
QLQLQESGPGLVKPSETLSLTCTVSGGSITSSSYYWGWIRQPPGKGLEWIGSIYYRGSTNYNPSLKSRVTISVDSSKNQFYLKVSSVTAVDTAVYYCARQNGAARPSWFDPWGQGTLVTVSS

SEQ ID NO: 7154 - protein, 10 aa, synthetic construct
  REGION 1..10: note = rinucumab heavy chain CDR1
GGSITSSSYY

SEQ ID NO: 7155 - protein, 8 aa, synthetic construct
  REGION 1..8: note = rinucumab heavy chain CDR2
IYYRGSTN

SEQ ID NO: 7156 - protein, 14 aa, synthetic construct
  REGION 1..14: note = rinucumab heavy chain CDR3
ARQNGAARPSWFDP

SEQ ID NO: 7157 - protein, 108 aa, synthetic construct
  REGION 1..108: note = rinucumab light chain V region
EIVLTQSPDTISLSPGERATLSCRASQSISSIYLAWYQQKPGQAPRLLIYGASSRVTGIPDRFSVSGSGTDFTLTISRLEPEDFAVYYCQHYGISPFTFGPGTKVDIR

SEQ ID NO: 7158 - protein, 7 aa, synthetic construct
  REGION 1..7: note = rinucumab light chain CDR1
QSISSIY

SEQ ID NO: 7159 - skipped

SEQ ID NO: 7160 - protein, 9 aa, synthetic construct
  REGION 1..9: note = rinucumab light chain CDR3
QHYGISPFT

SEQ ID NO: 7161 - protein, 120 aa, synthetic construct
  REGION 1..120: note = risankizumab heavy chain V region
QVQLVQSGAEVKKPGSSVKVSCKASGYTFTDQTIHWMRQAPGQGLEWIGYIYPRDDSPKYNENFKGKVTITADKSTSTAYMELSSLRSEDTAVYYCAIPDRSGYAWFIYWGQGTLVTVSS

SEQ ID NO: 7162 - protein, 8 aa, synthetic construct
  REGION 1..8: note = risankizumab heavy chain CDR1
GYTFTDQT

SEQ ID NO: 7163 - protein, 8 aa, synthetic construct
  REGION 1..8: note = risankizumab heavy chain CDR2
IYPRDDSP

SEQ ID NO: 7164 - protein, 13 aa, synthetic construct
  REGION 1..13: note = risankizumab heavy chain CDR3
AIPDRSGYAWFIY

SEQ ID NO: 7165 - protein, 107 aa, synthetic construct
  REGION 1..107: note = risankizumab light chain V region
DIQMTQSPSSLSASVGDRVTITCKASRDVAIAVAWYQQKPGKVPKLLIYWASTRHTGVPSRFSGSGSRTDFTLTISSLQPEDVADYFCHQYSSYPFTFGSGTKLEIK

SEQ ID NO: 7166 - protein, 6 aa, synthetic construct
  REGION 1..6: note = risankizumab light chain CDR1
RDVAIA

SEQ ID NO: 7167 - skipped

SEQ ID NO: 7168 - protein, 9 aa, synthetic construct
  REGION 1..9: note = risankizumab light chain CDR3
HQYSSYPFT

SEQ ID NO: 7169 - protein, 120 aa, synthetic construct
  REGION 1..120: note = rituximab heavy chain V region
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVS

SEQ ID NO: 7170 - protein, 8 aa, synthetic construct
  REGION 1..8: note = rituximab heavy chain CDR1
GYTFTSYN

SEQ ID NO: 7171 - protein, 8 aa, synthetic construct
  REGION 1..8: note = rituximab heavy chain CDR2
IYPGNGDT

SEQ ID NO: 7172 - protein, 14 aa, synthetic construct
  REGION 1..14: note = rituximab heavy chain CDR3
ARSTYYGGDWYFNV

SEQ ID NO: 7173 - protein, 106 aa, synthetic construct [sequence omitted]

SEQ ID NO: 7174 - protein, 5 aa, synthetic construct
  REGION 1..5: note = rituximab light chain CDR1
SSVSY

SEQ ID NO: 7175 - skipped

SEQ ID NO: 7176 - protein, 9 aa, synthetic construct
  REGION 1..9: note = rituximab light chain CDR3
QQWTSNPPT

SEQ ID NO: 7177 - protein, 118 aa, synthetic construct [sequence omitted]

SEQ ID NO: 7178 - protein, 8 aa, synthetic construct
  REGION 1..8: note = robatumumab heavy chain CDR1
GFTFSSFA

SEQ ID NO: 7179 - protein, 8 aa, synthetic construct
  REGION 1..8: note = robatumumab heavy chain CDR2
IDTRGATY

SEQ ID NO: 7180 - protein, 12 aa, synthetic construct
  REGION 1..12: note = robatumumab heavy chain CDR3
ARLGNFYYGMDV

SEQ ID NO: 7181 - protein, 107 aa, synthetic construct [sequence omitted]

SEQ ID NO: 7182 - protein, 6 aa, synthetic construct
  REGION 1..6: note = robatumumab light chain CDR1
QSIGSS

SEQ ID NO: 7183 - skipped

SEQ ID NO: 7184 - protein, 9 aa, synthetic construct
  REGION 1..9: note = robatumumab light chain CDR3
HQSSRLPHT

SEQ ID NO: 7185 - protein, 117 aa, synthetic construct
  REGION 1..117: note = rocatinlimab heavy chain V region
QITLKESGPTLVKPKQTLTLTCTFSGFSLSTSGMGVGWIRQPPGKALEWLAVIYWDDHQLYSPSLKSRLTITKDTSKNQVVLTMTNMDPVDTATYYCAHRRGAFQHWGQGTLVTVSS

SEQ ID NO: 7186 - protein, 10 aa, synthetic construct
  REGION 1..10: note = rocatinlimab heavy chain CDR1
GFSLSTSGMG

SEQ ID NO: 7187 - protein, 7 aa, synthetic construct
  REGION 1..7: note = rocatinlimab heavy chain CDR2
IYWDDHQ

SEQ ID NO: 7188 - protein, 9 aa, synthetic construct
  REGION 1..9: note = rocatinlimab heavy chain CDR3
AHRRGAFQH

SEQ ID NO: 7189 - protein, 107 aa, synthetic construct
  REGION 1..107: note = rocatinlimab light chain V region
EIVLTQSPGTLSLSPGERATLSCRASQSVSSSYLAWYQQKPGQAPRLLIYGASSRATGIPDRFSGSGSGTDFTLTISRLEPEDFAVYYCQQYDSSLTFGGGTKVEIK

SEQ ID NO: 7190 - protein, 7 aa, synthetic construct
  REGION 1..7: note = rocatinlimab light chain CDR1
QSVSSSY

SEQ ID NO: 7191 - skipped

SEQ ID NO: 7192 - protein, 7 aa, synthetic construct
  REGION 1..7: note = rocatinlimab light chain CDR3
QQYDSSL

SEQ ID NO: 7193 - protein, 126 aa, synthetic construct
  REGION 1..126: note = roledumab heavy chain V region
QVQLVESGGGVVQPGRSLRLSCTASGFTFKNYAMHWVRQAPAKGLEWVATISYDGRNIQYADSVKGRFTFSRDNSQDTLYLQLNSLRPEDTAVYYCARPVRSRWLQLGLEDAFHIWGQGTMVTVSS

SEQ ID NO: 7194 - protein, 7 aa, synthetic construct
  REGION 1..7: note = roledumab heavy chain CDR1
GFTFKNY

SEQ ID NO: 7195 - protein, 8 aa, synthetic construct
  REGION 1..8: note = roledumab heavy chain CDR2
ISYDGRNI

SEQ ID NO: 7196 - protein, 19 aa, synthetic construct
  REGION 1..19: note = roledumab heavy chain CDR3
ARPVRSRWLQLGLEDAFHI

SEQ ID NO: 7197 - protein, 106 aa, synthetic construct
  REGION 1..106: note = roledumab light chain V region
AIRMTQSPSSFSASTGDRVTITCRASQDIRNYVAWYQQKSGKAPKFLIYAASTLQSGVPSRFSGSGSGTDFTLTINSLQSEDFATYYCQQYYNSPPTFGQGTRVEI

SEQ ID NO: 7198 - protein, 6 aa, synthetic construct
  REGION 1..6: note = roledumab light chain CDR1
QDIRNY

SEQ ID NO: 7199 - skipped

SEQ ID NO: 7200 - protein, 9 aa, synthetic construct
  REGION 1..9: note = roledumab light chain CDR3
QQYYNSPPT

SEQ ID NO: 7201 - protein, 119 aa, synthetic construct
  REGION 1..119: note = romlusevimab heavy chain V region
QVQLVQSGSELKKPGASVKVSCKASGYTFTTYVMNWVRQAPGQGLEWMGWINTNTGNPTYAQGFTGRFVFSLDTSVSTASLQISSLKAEDTAVYYCSSEITTLGGMDVWGQGTTVTVSS

SEQ ID NO: 7202 - protein, 8 aa, synthetic construct
  REGION 1..8: note = romlusevimab heavy chain CDR1
GYTFTTYV

SEQ ID NO: 7203 - protein, 8 aa, synthetic construct
  REGION 1..8: note = romlusevimab heavy chain CDR2
INTNTGNP

SEQ ID NO: 7204 - protein, 12 aa, synthetic construct
  REGION 1..12: note = romlusevimab heavy chain CDR3
SSEITTLGGMDV

SEQ ID NO: 7205 - protein, 108 aa, synthetic construct
  REGION 1..108: note = romlusevimab light chain V region
SYVLTQPPSVSVAPGKTARITCGGNNIGSKSVHWYQQKPGQAPVLVIYYDSDRPSGIPERFSGSNSGNTATLTISGVEAGDEADYYCQVWDSISDHRVFGGGTKLTVL

SEQ ID NO: 7206 - protein, 6 aa, synthetic construct
  REGION 1..6: note = romlusevimab light chain CDR1
NIGSKS

SEQ ID NO: 7207 - skipped

SEQ ID NO: 7208 - protein, 11 aa, synthetic construct
  REGION 1..11: note = romlusevimab light chain CDR3
QVWDSISDHRV

SEQ ID NO: 7209 - protein, 123 aa, synthetic construct [sequence omitted]

SEQ ID NO: 7210 - protein, 8 aa, synthetic construct
  REGION 1..8: note = romosozumab heavy chain CDR1
GYTFTDYN

SEQ ID NO: 7211 - protein, 8 aa, synthetic construct
  REGION 1..8: note = romosozumab heavy chain CDR2
INPNSGGA

SEQ ID NO: 7212 - protein, 16 aa, synthetic construct
  REGION 1..16: note = romosozumab heavy chain CDR3
ARLGYDDIYDDWYFDV

SEQ ID NO: 7213 - protein, 107 aa, synthetic construct [sequence omitted]

SEQ ID NO: 7214 - protein, 6 aa, synthetic construct
  REGION 1..6: note = romosozumab light chain CDR1
QDISNY

SEQ ID NO: 7215 - skipped

SEQ ID NO: 7216 - protein, 9 aa, synthetic construct
  REGION 1..9: note = romosozumab light chain CDR3
QQGDTLPYT

SEQ ID NO: 7217 - protein, 117 aa, synthetic construct
  REGION 1..117: note = rosmantuzumab heavy chain V region
QVQLVQSGAEVKKPGASVKVSCKASGYTFTDYSIHWVRQAPGQGLEWIGYIYPSNGDSGYNQKFKNRVTMTRDTSTSTAYMELSRLRSEDTAVYYCATYFANNFDYWGQGTTLTVSS

SEQ ID NO: 7218 - protein, 8 aa, synthetic construct
  REGION 1..8: note = rosmantuzumab heavy chain CDR1
GYTFTDYS

SEQ ID NO: 7219 - protein, 8 aa, synthetic construct
  REGION 1..8: note = rosmantuzumab heavy chain CDR2
IYPSNGDS

SEQ ID NO: 7220 - protein, 10 aa, synthetic construct
  REGION 1..10: note = rosmantuzumab heavy chain CDR3
ATYFANNFDY

SEQ ID NO: 7221 - protein, 111 aa, synthetic construct
  REGION 1..111: note = rosmantuzumab light chain V region
DIQMTQSPSSLSASVGDRVTITCKASQSVDYDGDSYMNWYQQKPGKAPKLLIYAASNLESGVPSRFSGSGSGTDFTLTISPVQAEDFATYYCQQSNEDPLTFGAGTKLELK

SEQ ID NO: 7222 - protein, 10 aa, synthetic construct
  REGION 1..10: note = rosmantuzumab light chain CDR1
QSVDYDGDSY

SEQ ID NO: 7223 - skipped

SEQ ID NO: 7224 - protein, 9 aa, synthetic construct
  REGION 1..9: note = rosmantuzumab light chain CDR3
QQSNEDPLT

SEQ ID NO: 7225 - protein, 121 aa, synthetic construct; identical to SEQ ID NO: 7033
  REGION 1..121: note = rozibafusp alfa heavy chain V region

SEQ ID NO: 7226 - protein, 7 aa, synthetic construct
  REGION 1..7: note = rozibafusp alfa heavy chain CDR1
GFTFSSY

SEQ ID NO: 7227 - protein, 8 aa, synthetic construct
  REGION 1..8: note = rozibafusp alfa heavy chain CDR2
IKQDGNEK

SEQ ID NO: 7228 - protein, 14 aa, synthetic construct
  REGION 1..14: note = rozibafusp alfa heavy chain CDR3
AREGILWFGDLPTF

SEQ ID NO: 7229 - protein, 107 aa, synthetic construct; identical to SEQ ID NO: 7037
  REGION 1..107: note = rozibafusp alfa light chain V region

SEQ ID NO: 7230 - protein, 6 aa, synthetic construct
  REGION 1..6: note = rozibafusp alfa light chain CDR1
QGISNW

SEQ ID NO: 7231 - skipped

SEQ ID NO: 7232 - protein, 9 aa, synthetic construct
  REGION 1..9: note = rozibafusp alfa light chain CDR3
QQYDSYPRT

SEQ ID NO: 7233 - protein, 121 aa, synthetic construct
  REGION 1..121: note = sacituzumab govitecan heavy chain V region
QVQLQQSGSELKKPGASVKVSCKASGYTFTNYGMNWVKQAPGQGLKWMGWINTYTGEPTYTDDFKGRFAFSLDTSVSTAYLQISSLKADDTAVYFCARGGFGSSYWYFDVWGQGSLVTVSS

SEQ ID NO: 7234 - protein, 8 aa, synthetic construct
  REGION 1..8: note = sacituzumab govitecan heavy chain CDR1
GYTFTNYG

SEQ ID NO: 7235 - protein, 8 aa, synthetic construct
  REGION 1..8: note = sacituzumab govitecan heavy chain CDR2
INTYTGEP

SEQ ID NO: 7236 - protein, 14 aa, synthetic construct
  REGION 1..14: note = sacituzumab govitecan heavy chain CDR3
ARGGFGSSYWYFDV

SEQ ID NO: 7237 - protein, 107 aa, synthetic construct
  REGION 1..107: note = sacituzumab govitecan light chain V region
DIQLTQSPSSLSASVGDRVSITCKASQDVSIAVAWYQQKPGKAPKLLIYSASYRYTGVPDRFSGSGSGTDFTLTISSLQPEDFAVYYCQQHYITPLTFGAGTKVEIK

SEQ ID NO: 7238 - protein, 6 aa, synthetic construct
  REGION 1..6: note = sacituzumab govitecan light chain CDR1
QDVSIA

SEQ ID NO: 7239 - skipped

SEQ ID NO: 7240 - protein, 9 aa, synthetic construct
  REGION 1..9: note = sacituzumab govitecan light chain CDR3
QQHYITPLT

SEQ ID NO: 7241 - protein, 116 aa, synthetic construct
  REGION 1..116: note = sarilumab heavy chain V region
EVQLVESGGGLVQPGRSLRLSCAASRFTFDDYAMHWVRQAPGKGLEWVSGISWNSGRIGYADSVKGRFTISRDNAENSLFLQMNGLRAEDTALYYCAKGRDSFDIWGQGTMVTVSS

SEQ ID NO: 7242 - protein, 8 aa, synthetic construct
  REGION 1..8: note = sarilumab heavy chain CDR1
RFTFDDYA

SEQ ID NO: 7243 - protein, 8 aa, synthetic construct
  REGION 1..8: note = sarilumab heavy chain CDR2
ISWNSGRI

SEQ ID NO: 7244 - protein, 9 aa, synthetic construct
  REGION 1..9: note = sarilumab heavy chain CDR3
AKGRDSFDI

SEQ ID NO: 7245 - protein, 107 aa, synthetic construct
  REGION 1..107: note = sarilumab light chain V region
DIQMTQSPSSVSASVGDRVTITCRASQGISSWLAWYQQKPGKAPKLLIYGASSLESGVPSRFSGSGSGTDFTLTISSLQPEDFASYYCQQANSFPYTFGQGTKLEIK

SEQ ID NO: 7246 - protein, 6 aa, synthetic construct
  REGION 1..6: note = sarilumab light chain CDR1
QGISSW

SEQ ID NO: 7247 - skipped

SEQ ID NO: 7248 - protein, 9 aa, synthetic construct
  REGION 1..9: note = sarilumab light chain CDR3
QQANSFPYT

SEQ ID NO: 7249 - protein, 119 aa, synthetic construct
  REGION 1..119: note = satralizumab heavy chain V region
QVQLQESGPGLVKPSETLSLTCAVSGHSISHDHAWSWVRQPPGEGLEWIGFISYSGITNYNPSLQGRVTISRDNSKNTLYLQMNSLRAEDTAVYYCARSLARTTAMDYWGEGTLVTVSS

SEQ ID NO: 7250 - protein, 9 aa, synthetic construct
  REGION 1..9: note = satralizumab heavy chain CDR1
GHSISHDHA

SEQ ID NO: 7251 - protein, 7 aa, synthetic construct
  REGION 1..7: note = satralizumab heavy chain CDR2
ISYSGIT

SEQ ID NO: 7252 - protein, 12 aa, synthetic construct
  REGION 1..12: note = satralizumab heavy chain CDR3
ARSLARTTAMDY

SEQ ID NO: 7253 - protein, 107 aa, synthetic construct
  REGION 1..107: note = satralizumab light chain V region
DIQMTQSPSSLSASVGDSVTITCQASTDISSHLNWYQQKPGKAPELLIYYGSHLLSGVPSRFSGSGSGTDFTFTISSLEAEDAATYYCGQGNRLPYTFGQGTKVEIE

SEQ ID NO: 7254 - protein, 6 aa, synthetic construct
  REGION 1..6: note = satralizumab light chain CDR1
TDISSH

SEQ ID NO: 7255 - skipped

SEQ ID NO: 7256 - protein, 9 aa, synthetic construct
  REGION 1..9: note = satralizumab light chain CDR3
GQGNRLPYT

SEQ ID NO: 7257 - protein, 127 aa, synthetic construct [sequence omitted]

SEQ ID NO: 7258 - protein, 8 aa, synthetic construct
  REGION 1..8: note = secukinumab heavy chain CDR1
GFTFSNYW

SEQ ID NO: 7259 - protein, 8 aa, synthetic construct
  REGION 1..8: note = secukinumab heavy chain CDR2
INQDGSEK

SEQ ID NO: 7260 - protein, 20 aa, synthetic construct [sequence omitted]

SEQ ID NO: 7261 - protein, 108 aa, synthetic construct [sequence omitted]

SEQ ID NO: 7262 - protein, 7 aa, synthetic construct
  REGION 1..7: note = secukinumab light chain CDR1
QSVSSSY

SEQ ID NO: 7263 - skipped

SEQ ID NO: 7264 - protein, 9 aa, synthetic construct
  REGION 1..9: note = secukinumab light chain CDR3
QQYGSSPCT

SEQ ID NO: 7265 - protein, 126 aa, synthetic construct
  REGION 1..126: note = selicrelumab heavy chain V region
QVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSS

SEQ ID NO: 7266 - protein, 8 aa, synthetic construct
  REGION 1..8: note = selicrelumab heavy chain CDR1
GYTFTGYY

SEQ ID NO: 7267 - protein, 8 aa, synthetic construct
  REGION 1..8: note = selicrelumab heavy chain CDR2
INPDSGGT

SEQ ID NO: 7268 - protein, 19 aa, synthetic construct
  REGION 1..19: note = selicrelumab heavy chain CDR3
ARDQPLGYCTNGVCSYFDY

SEQ ID NO: 7269 - protein, 107 aa, synthetic construct
  REGION 1..107: note = selicrelumab light chain V region
DIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIK

SEQ ID NO: 7270 - protein, 7 aa, synthetic construct
  REGION 1..7: note = selicrelumab light chain CDR1
QGIYSWL

SEQ ID NO: 7271 - skipped

SEQ ID NO: 7272 - protein, 9 aa, synthetic construct
  REGION 1..9: note = selicrelumab light chain CDR3
QQANIFPLT

SEQ ID NO: 7273 - protein, 119 aa, synthetic construct [sequence omitted]

SEQ ID NO: 7274 - protein, 8 aa, synthetic construct
  REGION 1..8: note = seribantumab heavy chain CDR1
GFTFSHYV

SEQ ID NO: 7275 - protein, 8 aa, synthetic construct
  REGION 1..8: note = seribantumab heavy chain CDR2
ISSSGGWT

SEQ ID NO: 7276 - protein, 12 aa, synthetic construct
  REGION 1..12: note = seribantumab heavy chain CDR3
TRGLKMATIFDY

SEQ ID NO: 7277 - protein, 111 aa, synthetic construct [sequence omitted]

SEQ ID NO: 7278 - protein, 8 aa, synthetic construct
  REGION 1..8: note = seribantumab light chain CDR1
SSDVGSYN

SEQ ID NO: 7279 - skipped

SEQ ID NO: 7280 - protein, 10 aa, synthetic construct
  REGION 1..10: note = seribantumab light chain CDR3
SYAGSSIFVI

SEQ ID NO: 7281 - protein, 117 aa, synthetic construct
  REGION 1..117: note = setrusumab heavy chain V region
QVQLVESGGGLVQPGGSLRLSCAASGFTFRSHWLSWVRQAPGKGLEWVSNINYDGSSTYYADSVKGRFTISRDNSKNTLYLQMNSLRAEDTAVYYCARDTYLHFDYWGQGTLVTVSS

SEQ ID NO: 7282 - protein, 8 aa, synthetic construct
  REGION 1..8: note = setrusumab heavy chain CDR1
GFTFRSHW

SEQ ID NO: 7283 - protein, 8 aa, synthetic construct
  REGION 1..8: note = setrusumab heavy chain CDR2
INYDGSST

SEQ ID NO: 7284 - protein, 10 aa, synthetic construct
  REGION 1..10: note = setrusumab heavy chain CDR3
ARDTYLHFDY

SEQ ID NO: 7285 - protein, 111 aa, synthetic construct
  REGION 1..111: note = setrusumab light chain V region
DIALTQPASVSGSPGQSITISCTGTSSDVGDINDVSWYQQHPGKAPKLMIYDVNNRPSGVSNRFSGSKSGNTASLTISGLQAEDEADYYCQSYAGSYLSEVFGGGTKLTVL

SEQ ID NO: 7286 - protein, 9 aa, synthetic construct
  REGION 1..9: note = setrusumab light chain CDR1
SSDVGDIND

SEQ ID NO: 7287 - skipped

SEQ ID NO: 7288 - protein, 11 aa, synthetic construct
  REGION 1..11: note = setrusumab light chain CDR3
QSYAGSYLSEV

SEQ ID NO: 7289 - protein, 116 aa, synthetic construct [sequence omitted]

SEQ ID NO: 7290 - protein, 8 aa, synthetic construct
  REGION 1..8: note = sifalimumab heavy chain CDR1
GYTFTSYS

SEQ ID NO: 7291 - protein, 8 aa, synthetic construct
  REGION 1..8: note = sifalimumab heavy chain CDR2
ISVYNGNT

SEQ ID NO: 7292 - protein, 9 aa, synthetic construct
  REGION 1..9: note = sifalimumab heavy chain CDR3
ARDPIAAGY

SEQ ID NO: 7293 - protein, 108 aa, synthetic construct [sequence omitted]

SEQ ID NO: 7294 - protein, 7 aa, synthetic construct
  REGION 1..7: note = sifalimumab light chain CDR1
QSVSSTY

SEQ ID NO: 7295 - skipped

SEQ ID NO: 7296 - protein, 9 aa, synthetic construct
  REGION 1..9: note = sifalimumab light chain CDR3
QQYGSSPRT

SEQ ID NO: 7297 - protein, 119 aa, synthetic construct [sequence omitted]

SEQ ID NO: 7298 - protein, 8 aa, synthetic construct
  REGION 1..8: note = siltuximab heavy chain CDR1
GFTFSSFA

SEQ ID NO: 7299 - protein, 8 aa, synthetic construct
  REGION 1..8: note = siltuximab heavy chain CDR2
ISSGGSYT

SEQ ID NO: 7300 - protein, 12 aa, synthetic construct
  REGION 1..12: note = siltuximab heavy chain CDR3
ARGLWGYYALDY

SEQ ID NO: 7301 - protein, 106 aa, synthetic construct [sequence omitted]

SEQ ID NO: 7302 - protein, 5 aa, synthetic construct
  REGION 1..5: note = siltuximab light chain CDR1
SSVSY

SEQ ID NO: 7303 - skipped

SEQ ID NO: 7304 - protein, 9 aa, synthetic construct
  REGION 1..9: note = siltuximab light chain CDR3
QQWSGYPYT

SEQ ID NO: 7305 - protein, 120 aa, synthetic construct
  REGION 1..120: note = sintilimab heavy chain V region
QVQLVQSGAEVKKPGSSVKVSCKASGGTFSSYAISWVRQAPGQGLEWMGLIIPMFDTAGYAQKFQGRVAITVDESTSTAYMELSSLRSEDTAVYYCARAEHSSTGTFDYWGQGTLVTVSS

SEQ ID NO: 7306 - protein, 8 aa, synthetic construct
  REGION 1..8: note = sintilimab heavy chain CDR1
GGTFSSYA

SEQ ID NO: 7307 - protein, 9 aa, synthetic construct
  REGION 1..9: note = sintilimab heavy chain CDR2
IIPMFDTAG

SEQ ID NO: 7308 - protein, 13 aa, synthetic construct
  REGION 1..13: note = sintilimab heavy chain CDR3
ARAEHSSTGTFDY

SEQ ID NO: 7309 - protein, 107 aa, synthetic construct; identical to SEQ ID NO: 6069
  REGION 1..107: note = sintilimab light chain V region

SEQ ID NO: 7310 - protein, 6 aa, synthetic construct
  REGION 1..6: note = sintilimab light chain CDR1
QGISSW

SEQ ID NO: 7311 - skipped

SEQ ID NO: 7312 - protein, 9 aa, synthetic construct
  REGION 1..9: note = sintilimab light chain CDR3
QQANHLPFT

SEQ ID NO: 7313 - protein, 120 aa, synthetic construct
  REGION 1..120: note = sirtratumab heavy chain V region
QVQLVESGGGVVQPGRSLRLSCAASGFTFSSYGMHWVRQAPGKGLEWVAVIWYDGSNQYYADSVKGRFTISRDNSKNTLFLQMHSLRAEDTAVYYCARGLTSGRYGMDVWGQGTTVTVSS

SEQ ID NO: 7314 - protein, 7 aa, synthetic construct
  REGION 1..7: note = sirtratumab heavy chain CDR1
GFTFSSY

SEQ ID NO: 7315 - protein, 8 aa, synthetic construct
  REGION 1..8: note = sirtratumab heavy chain CDR2
IWYDGSNQ

SEQ ID NO: 7316 - protein, 13 aa, synthetic construct
  REGION 1..13: note = sirtratumab heavy chain CDR3
ARGLTSGRYGMDV

SEQ ID NO: 7317 - protein, 112 aa, synthetic construct
  REGION 1..112: note = sirtratumab light chain V region
DIVMTQSPLSLPVTPGEPASISCRSSQSLLLSHGFNYLDWYLQKPGQSPQLLIYLGSSRASGVPDRFSGSGSGTDFTLKISRVEAEDVGLYYCMQPLQIPWTFGQGTKVEIK

SEQ ID NO: 7318 - protein, 11 aa, synthetic construct
  REGION 1..11: note = sirtratumab light chain CDR1
QSLLLSHGFNY

SEQ ID NO: 7319 - skipped

SEQ ID NO: 7320 - protein, 8 aa, synthetic construct
  REGION 1..8: note = sirtratumab light chain CDR3
QPLQIPWT

SEQ ID NO: 7321 - protein, 120 aa, synthetic construct; identical to SEQ ID NO: 7313
  REGION 1..120: note = sirtratumab vedotin heavy chain V region

SEQ ID NO: 7322 - protein, 7 aa, synthetic construct
  REGION 1..7: note = sirtratumab vedotin heavy chain CDR1
GFTFSSY

SEQ ID NO: 7323 - protein, 8 aa, synthetic construct
  REGION 1..8: note = sirtratumab vedotin heavy chain CDR2
IWYDGSNQ

SEQ ID NO: 7324 - protein, 13 aa, synthetic construct
  REGION 1..13: note = sirtratumab vedotin heavy chain CDR3
ARGLTSGRYGMDV

SEQ ID NO: 7325 - protein, 112 aa, synthetic construct; identical to SEQ ID NO: 7317
  REGION 1..112: note = sirtratumab vedotin light chain V region

SEQ ID NO: 7326 - protein, 10 aa, synthetic construct
  REGION 1..10: note = sirtratumab vedotin light chain CDR1
SLLLSHGFNY

SEQ ID NO: 7327 - skipped

SEQ ID NO: 7328 - protein, 9 aa, synthetic construct
  REGION 1..9: note = sirtratumab vedotin light chain CDR3
MQPLQIPWT

SEQ ID NO: 7329 - protein, 119 aa, synthetic construct
  REGION 1..119: note = sirukumab heavy chain V region
EVQLVESGGGLVQPGGSLRLSCAASGFTFSPFAMSWVRQAPGKGLEWVAKISPGGSWTYYSDTVTGRFTISRDNAKNSLYLQMNSLRAEDTAVYYCARQLWGYYALDIWGQGTTVTVSS

SEQ ID NO: 7330 - protein, 8 aa, synthetic construct
  REGION 1..8: note = sirukumab heavy chain CDR1
GFTFSPFA

SEQ ID NO: 7331 - protein, 8 aa, synthetic construct
  REGION 1..8: note = sirukumab heavy chain CDR2
ISPGGSWT

SEQ ID NO: 7332 - protein, 12 aa, synthetic construct
  REGION 1..12: note = sirukumab heavy chain CDR3
ARQLWGYYALDI

SEQ ID NO: 7333 - protein, 106 aa, synthetic construct
  REGION 1..106: note = sirukumab light chain V region
EIVLTQSPATLSLSPGERATLSCSASISVSYMYWYQQKPGQAPRLLIYDMSNLASGIPARFSGSGSGTDFTLTISSLEPEDFAVYYCMQWSGYPYTFGGGTKVEIK

SEQ ID NO: 7334 - protein, 5 aa, synthetic construct
  REGION 1..5: note = sirukumab light chain CDR1
ISVSY

SEQ ID NO: 7335 - skipped

SEQ ID NO: 7336 - protein, 9 aa, synthetic construct
  REGION 1..9: note = sirukumab light chain CDR3
MQWSGYPYT

SEQ ID NO: 7337 - protein, 119 aa, synthetic construct
  REGION 1..119: note = socazolimab heavy chain V region
EVQLVESGAEVKKPGSSVKVSCKASGGTFSSYAISWVRQAPGQGLEWMGGIIPIFGTANYAQKFQGRVTITADESTSTAYMELSSLRSEDTAVYYCARAPYYYYYMDVWGQGTTVTVSS

SEQ ID NO: 7338 - protein, 7 aa, synthetic construct
  REGION 1..7: note = socazolimab heavy chain CDR1
GGTFSSY

SEQ ID NO: 7339 - protein, 8 aa, synthetic construct
  REGION 1..8: note = socazolimab heavy chain CDR2
IIPIFGTA

SEQ ID NO: 7340 - protein, 12 aa, synthetic construct
  REGION 1..12: note = socazolimab heavy chain CDR3
ARAPYYYYYMDV

SEQ ID NO: 7341 - protein, 109 aa, synthetic construct
  REGION 1..109: note = socazolimab light chain V region
QSALTQPASVSGSLGQSVTISCTGSSSDVGSYNLVSWYQQHPGKAPNLMIYDVSKRSGVSNRFSGSKSGNTASLTISGLQAEDEADYYCSSYTGISTVVFGGGTKLTVL

SEQ ID NO: 7342 - protein, 9 aa, synthetic construct
  REGION 1..9: note = socazolimab light chain CDR1
SSDVGSYNL

SEQ ID NO: 7343 - skipped

SEQ ID NO: 7344 - protein, 10 aa, synthetic construct
  REGION 1..10: note = socazolimab light chain CDR3
SSYTGISTVV

SEQ ID NO: 7345 - protein, 123 aa, synthetic construct
  REGION 1..123: note = sonelokimab heavy chain 1 V region
DVQLVESGGGLVQPGGSLRLSCAASGRTFSSYVVGWFRQAPGKEREFIGAISGSGESIYYAVSEKGRFTISRDNSKNTLYLQMNSLRPEDTAVYYCTADQEFGYLRFGRSEYWGQGTLVTVSS

SEQ ID NO: 7346 - protein, 7 aa, synthetic construct
  REGION 1..7: note = sonelokimab heavy chain 1 CDR1
GRTFSSY

SEQ ID NO: 7347 - protein, 8 aa, synthetic construct
  REGION 1..8: note = sonelokimab heavy chain 1 CDR2
ISGSGESI

SEQ ID NO: 7348 - protein, 16 aa, synthetic construct
  REGION 1..16: note = sonelokimab heavy chain 1 CDR3
TADQEFGYLRFGRSEY

SEQ ID NO: 7349 - protein, 115 aa, synthetic construct [sequence omitted]

SEQ ID NO: 7350 - protein, 7 aa, synthetic construct
  REGION 1..7: note = sonelokimab heavy chain 2 CDR1
GFTFSSF

SEQ ID NO: 7351 - protein, 8 aa, synthetic construct
  REGION 1..8: note = sonelokimab heavy chain 2 CDR2
ISGSGSDT

SEQ ID NO: 7352 - protein, 13 aa, synthetic construct
  REGION 1..13: note = sonelokimab heavy chain 2 CDR3
TIGGSLSRSSQGT

SEQ ID NO: 7353 - protein, 122 aa, synthetic construct
  REGION 1..122: note = sonelokimab heavy chain 3 V region
EVQLVESGGGLVQPGGSLRLSCAASGRTYDAMGWLRQAPGKEREFVAAISGSGDDTYYADSVKGRFTISRDNSKNTLYLQMNSLRPEDTAVYYCATRRGLYYVWDANDYENWGQGTLVTVSS

SEQ ID NO: 7354 - protein, 6 aa, synthetic construct
  REGION 1..6: note = sonelokimab heavy chain 3 CDR1
GRTYDA

SEQ ID NO: 7355 - protein, 8 aa, synthetic construct
  REGION 1..8: note = sonelokimab heavy chain 3 CDR2
ISGSGDDT

SEQ ID NO: 7356 - protein, 16 aa, synthetic construct
  REGION 1..16: note = sonelokimab heavy chain 3 CDR3
ATRRGLYYVWDANDYE

SEQ ID NO: 7357 - protein, 127 aa, synthetic construct; identical to SEQ ID NO: 456
  REGION 1..127: note = sotrovimab heavy chain V region

SEQ ID NO: 7358 - protein, 8 aa, synthetic construct
  REGION 1..8: note = sotrovimab heavy chain CDR1
GYPFTSYG

SEQ ID NO: 7359 - protein, 8 aa, synthetic construct
  REGION 1..8: note = sotrovimab heavy chain CDR2
ISTYQGNT

SEQ ID NO: 7360 - protein, 20 aa, synthetic construct
  REGION 1..20: note = sotrovimab heavy chain CDR3
ARDYTRGAWFGESLIGGFDN

SEQ ID NO: 7361 - protein, 107 aa, synthetic construct [sequence omitted]

SEQ ID NO: 7362 - protein, 7 aa, synthetic construct
  REGION 1..7: note = sotrovimab light chain CDR1
QTVSSTS

SEQ ID NO: 7363 - skipped

SEQ ID NO: 7364 - protein, 8 aa, synthetic construct
  REGION 1..8: note = sotrovimab light chain CDR3
QQHDTSLT

SEQ ID NO: 7365 - protein, 118 aa, synthetic construct [sequence omitted]

SEQ ID NO: 7366 - protein, 8 aa, synthetic construct
  REGION 1..8: note = sudubrilimab heavy chain CDR1
GFTFSETW

SEQ ID NO: 7367 - protein, 8 aa, synthetic construct
  REGION 1..8: note = sudubrilimab heavy chain CDR2
VSPFGGST

SEQ ID NO: 7368 - protein, 11 aa, synthetic construct
  REGION 1..11: note = sudubrilimab heavy chain CDR3
ARRHWPGGFDY

SEQ ID NO: 7369 - protein, 107 aa, synthetic construct [sequence omitted]

SEQ ID NO: 7370 - protein, 6 aa, synthetic construct
  REGION 1..6: note = sudubrilimab light chain CDR1
QDVSTA

SEQ ID NO: 7371 - skipped

SEQ ID NO: 7372 - protein, 9 aa, synthetic construct
  REGION 1..9: note = sudubrilimab light chain CDR3
QQFLYHPAT

SEQ ID NO: 7373 - protein, 121 aa, synthetic construct
  REGION 1..121: note = sugemalimab heavy chain V region
EVQLLESGGGLVQPGGSLRLSCAASGFTFSSYAMSWVRQAPGKGLEWVSGISGSGGFTYYADSVKGRFTISRDNSKNTLYLQMNSLRAEDTAVYYCAKPPRGYNYGPFDYWGQGTLVTVSS

SEQ ID NO: 7374 - protein, 7 aa, synthetic construct
  REGION 1..7: note = sugemalimab heavy chain CDR1
GFTFSSY

SEQ ID NO: 7375 - protein, 8 aa, synthetic construct
  REGION 1..8: note = sugemalimab heavy chain CDR2
ISGSGGFT

SEQ ID NO: 7376 - protein, 14 aa, synthetic construct
  REGION 1..14: note = sugemalimab heavy chain CDR3
AKPPRGYNYGPFDY

SEQ ID NO: 7377 - protein, 108 aa, synthetic construct
  REGION 1..108: note = sugemalimab light chain V region
SYVLTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVL

SEQ ID NO: 7378 - protein, 6 aa, synthetic construct
  REGION 1..6: note = sugemalimab light chain CDR1
NIGSKS

SEQ ID NO: 7379 - skipped

SEQ ID NO: 7380 - protein, 11 aa, synthetic construct
  REGION 1..11: note = sugemalimab light chain CDR3
QVWDSSSDHVV

SEQ ID NO: 7381 - protein, 123 aa, synthetic construct
  REGION 1..123: note = suptavumab heavy chain V region
EVQLVESGGDLVQPGRSLRLSCVASGFTFDDYAMHWVRQAPGKGLEWVSGVSWSGSTVGYADSVKGRFTVSRDNAQKSLYLQMNSLRAEDTALYYCVKDAYKFNYYYYGLDVWGQGTTVTVSS

SEQ ID NO: 7382 - protein, 8 aa, synthetic construct
  REGION 1..8: note = suptavumab heavy chain CDR1
GFTFDDYA

SEQ ID NO: 7383 - protein, 8 aa, synthetic construct
  REGION 1..8: note = suptavumab heavy chain CDR2
VSWSGSTV

SEQ ID NO: 7384 - protein, 16 aa, synthetic construct
  REGION 1..16: note = suptavumab heavy chain CDR3
VKDAYKFNYYYYGLDV

SEQ ID NO: 7385 - protein, 107 aa, synthetic construct
  REGION 1..107: note = suptavumab light chain V region
EIVMTQSPATLSVSPGERATLSCRASQTILSNLAWYLQKPGQAPRLLIYGASTRATGLPARFSGSGSGTEFTLTISSLQSEDFAVYYCQQYNNWPLTFGGGTKVEIK

SEQ ID NO: 7386 - protein, 6 aa, synthetic construct
  REGION 1..6: note = suptavumab light chain CDR1
QTILSN

SEQ ID NO: 7387 - skipped

SEQ ID NO: 7388 - protein, 9 aa, synthetic construct
  REGION 1..9: note = suptavumab light chain CDR3
QQYNNWPLT

SEQ ID NO: 7389 - protein, 119 aa, synthetic construct
  REGION 1..119: note = surzebiclimab heavy chain V region
EVQLVESGGGLVQPGGSLRLSCAASGFTFSRYAMSWVRQAPGKGLEWVAAISSGGSLYYPDSVKGRFTISRDNAKNTLYLQMNSLRAEDTAVYYCARGREADGGYFDYWGQGTLVTVSS

SEQ ID NO: 7390 - protein, 7 aa, synthetic construct
  REGION 1..7: note = surzebiclimab heavy chain CDR1
GFTFSRY

SEQ ID NO: 7391 - protein, 7 aa, synthetic construct
  REGION 1..7: note = surzebiclimab heavy chain CDR2
ISSGGSL

SEQ ID NO: 7392 - protein, 13 aa, synthetic construct
  REGION 1..13: note = surzebiclimab heavy chain CDR3
ARGREADGGYFDY

SEQ ID NO: 7393 - protein, 111 aa, synthetic construct
  REGION 1..111: note = surzebiclimab light chain V region
EIVLTQSPATLSVSPGERATLSCRASESVEYYGTSLMQWYQQKPGQAPRLLIYAASNVESGIPARFSGSGSGTEFTLTISSLQSEDFAVYYCQQSLKVPLTFGGGTKVEIK

SEQ ID NO: 7394 - protein, 10 aa, synthetic construct
  REGION 1..10: note = surzebiclimab light chain CDR1
ESVEYYGTSL

SEQ ID NO: 7395 - skipped

SEQ ID NO: 7396 - protein, 9 aa, synthetic construct
  REGION 1..9: note = surzebiclimab light chain CDR3
QQSLKVPLT

SEQ ID NO: 7397 - protein, 122 aa, synthetic construct
  REGION 1..122: note = suvratoxumab heavy chain V region
EVQLVESGGGLVQPGGSLRLSCAASGFTFSSHDMHWVRQATGKGLEWVSGIGTAGDTYYPDSVKGRFTISRENAKNSLYLQMNSLRAGDTAVYYCARDRYSPTGHYYGMDVWGQGTTVTVSS

SEQ ID NO: 7398 - protein, 8 aa, synthetic construct
  REGION 1..8: note = suvratoxumab heavy chain CDR1
GFTFSSHD

SEQ ID NO: 7399 - protein, 7 aa, synthetic construct
  REGION 1..7: note = suvratoxumab heavy chain CDR2
IGTAGDT

SEQ ID NO: 7400 - protein, 16 aa, synthetic construct
  REGION 1..16: note = suvratoxumab heavy chain CDR3
ARDRYSPTGHYYGMDV

SEQ ID NO: 7401 - protein, 106 aa, synthetic construct
  REGION 1..106: note = suvratoxumab light chain V region
DIQMTQSPSTLSASVGDRVTITCRASQSISSWLAWYQQKPGKAPKLLIYKASSLESGVPSRFSGSGSGTEFTLTISSLQPDDFATYYCKQYADYWTFGQGTKVEIK

SEQ ID NO: 7402 - protein, 6 aa, synthetic construct
  REGION 1..6: note = suvratoxumab light chain CDR1
QSISSW

SEQ ID NO: 7403 - skipped

SEQ ID NO: 7404 - protein, 8 aa, synthetic construct
  REGION 1..8: note = suvratoxumab light chain CDR3
KQYADYWT

SEQ ID NO: 7405 - protein, 123 aa, synthetic construct [sequence omitted]

SEQ ID NO: 7406 - protein, 8 aa, synthetic construct
  REGION 1..8: note = tabalumab heavy chain CDR1
GGSFSGYY

SEQ ID NO: 7407 - protein, 7 aa, synthetic construct
  REGION 1..7: note = tabalumab heavy chain CDR2
INHSGST

SEQ ID NO: 7408 - protein, 17 aa, synthetic construct
  REGION 1..17: note = tabalumab heavy chain CDR3
ARGYYDILTGYYYYFDY

SEQ ID NO: 7409 - protein, 107 aa, synthetic construct [sequence omitted]

SEQ ID NO: 7410 - protein, 6 aa, synthetic construct
  REGION 1..6: note = tabalumab light chain CDR1
QSVSRY

SEQ ID NO: 7411 - skipped

SEQ ID NO: 7412 - protein, 9 aa, synthetic construct
  REGION 1..9: note = tabalumab light chain CDR3
QQRSNWPRT

SEQ ID NO: 7413 - protein, 118 aa, synthetic construct
  REGION 1..118: note = tabituximab heavy chain V region
EVQLQQSGAELVKPGASVKLSCTASGFNINDTYMHWVKQRPEQGLEWIGRIDPANGNTKYDPKFQGKATITADTSSNTAYLQLSSLTSEDTAVYYCARGARGSRFAYWGQGTLVTVSA

SEQ ID NO: 7414 - protein, 8 aa, synthetic construct
  REGION 1..8: note = tabituximab heavy chain CDR1
GFNINDTY

SEQ ID NO: 7415 - protein, 8 aa, synthetic construct
  REGION 1..8: note = tabituximab heavy chain CDR2
IDPANGNT

SEQ ID NO: 7416 - protein, 11 aa, synthetic construct
  REGION 1..11: note = tabituximab heavy chain CDR3
ARGARGSRFAY

SEQ ID NO: 7417 - protein, 107 aa, synthetic construct
  REGION 1..107: note = tabituximab light chain V region
DIQMTQSPASLSVSVGETVTITCRASENIYSNLAWYQQKQGKSPQLLVYVATNLADGVPSRFSGSGSGTQYSLKINSLQSEDFGSYYCQHFWGTPYTFGGGTKLEIK

SEQ ID NO: 7418 - protein, 6 aa, synthetic construct
  REGION 1..6: note = tabituximab light chain CDR1
ENIYSN

SEQ ID NO: 7419 - skipped

SEQ ID NO: 7420 - protein, 9 aa, synthetic construct
  REGION 1..9: note = tabituximab light chain CDR3
QHFWGTPYT

SEQ ID NO: 7421 - protein, 118 aa, synthetic construct; identical to SEQ ID NO: 7413
  REGION 1..118: note = tabituximab barzuxetan heavy chain V region

SEQ ID NO: 7422 - protein, 8 aa, synthetic construct
  REGION 1..8: note = tabituximab barzuxetan heavy chain CDR1
GFNINDTY

SEQ ID NO: 7423 - protein, 8 aa, synthetic construct
  REGION 1..8: note = tabituximab barzuxetan heavy chain CDR2
IDPANGNT

SEQ ID NO: 7424 - protein, 11 aa, synthetic construct
  REGION 1..11: note = tabituximab barzuxetan heavy chain CDR3
ARGARGSRFAY

SEQ ID NO: 7425 - protein, 107 aa, synthetic construct; identical to SEQ ID NO: 7417
  REGION 1..107: note = tabituximab barzuxetan light chain V region

SEQ ID NO: 7426 - protein, 6 aa, synthetic construct
  REGION 1..6: note = tabituximab barzuxetan light chain CDR1
ENIYSN

SEQ ID NO: 7427 - skipped

SEQ ID NO: 7428 - protein, 9 aa, synthetic construct
  REGION 1..9: note = tabituximab barzuxetan light chain CDR3
QHFWGTPYT

SEQ ID NO: 7429 - protein, 121 aa, synthetic construct
  REGION 1..121: note = tafasitamab heavy chain V region
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSS

SEQ ID NO: 7430 - protein, 8 aa, synthetic construct
  REGION 1..8: note = tafasitamab heavy chain CDR1
GYTFTSYV

SEQ ID NO: 7431 - protein, 8 aa, synthetic construct
  REGION 1..8: note = tafasitamab heavy chain CDR2
INPYNDGT

SEQ ID NO: 7432 - protein, 14 aa, synthetic construct
  REGION 1..14: note = tafasitamab heavy chain CDR3
ARGTYYYGTRVFDY

SEQ ID NO: 7433 - protein, 112 aa, synthetic construct
  REGION 1..112: note = tafasitamab light chain V region
DIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIK

SEQ ID NO: 7434 - protein, 11 aa, synthetic construct
  REGION 1..11: note = tafasitamab light chain CDR1
KSLQNVNGNTY

SEQ ID NO: 7435 - skipped

SEQ ID NO: 7436 - protein, 9 aa, synthetic construct
  REGION 1..9: note = tafasitamab light chain CDR3
MQHLEYPIT

SEQ ID NO: 7437 - protein, 126 aa, synthetic construct
  REGION 1..126: note = tafolecimab heavy chain V region
QLQLQESGPGLVKPSETLSLTCTVSGGSISSASYYWSWIRQPPGKGLEWIGSINYRGSTYYNPSLKSRVTISVDTSKNQFSLKLSSVTAADTAVYYCARENSGVVPAAGPNWFGPWGQGTLVTVSS

SEQ ID NO: 7438 - protein, 10 aa, synthetic construct
  REGION 1..10: note = tafolecimab heavy chain CDR1
GGSISSASYY

SEQ ID NO: 7439 - protein, 7 aa, synthetic construct
  REGION 1..7: note = tafolecimab heavy chain CDR2
INYRGST

SEQ ID NO: 7440 - protein, 18 aa, synthetic construct
  REGION 1..18: note = tafolecimab heavy chain CDR3
ARENSGVVPAAGPNWFGP

SEQ ID NO: 7441 - protein, 106 aa, synthetic construct
  REGION 1..106: note = tafolecimab light chain V region
EIVLTQSPATLSLSPGERATLSCRASQSVSSYLAWYQQKPGQAPRLLIYDASNRATGIPARFSGSGSGTDFTLTISSLEPEDFAVYYCQQRRNWFTFGGGTKVEIK

SEQ ID NO: 7442 - protein, 6 aa, synthetic construct
  REGION 1..6: note = tafolecimab light chain CDR1
QSVSSY

SEQ ID NO: 7443 - skipped

SEQ ID NO: 7444 - protein, 8 aa, synthetic construct
  REGION 1..8: note = tafolecimab light chain CDR3
QQRRNWFT

SEQ ID NO: 7445 - protein, 120 aa, synthetic construct
  REGION 1..120: note = tagitanlimab heavy chain V region
QVQLQESGPGLVKPSETLSITCTVSGFSLSNYDISWIRQPPGKGLEWLGVIWTGGATNYNPALKSRLTISRDNSKNQVSLKMSSVTAADTAVYYCVRDSNYRYDEPFTYWGQGTLVTVSS

SEQ ID NO: 7446 - protein, 8 aa, synthetic construct
  REGION 1..8: note = tagitanlimab heavy chain CDR1
GFSLSNYD

SEQ ID NO: 7447 - protein, 7 aa, synthetic construct
  REGION 1..7: note = tagitanlimab heavy chain CDR2
IWTGGAT

SEQ ID NO: 7448 - protein, 14 aa, synthetic construct
  REGION 1..14: note = tagitanlimab heavy chain CDR3
VRDSNYRYDEPFTY

SEQ ID NO: 7449 - protein, 107 aa, synthetic construct
  REGION 1..107: note = tagitanlimab light chain V region
EIVLTQSPDTLSVTPKEKVTLTCRASQSIGTNIHWFQQKPGQSPKLLIKYASESISGVPSRFSGSGSGTDFTLTINSVEAEDAATYYCQQSNSWPYTFGQGTKLEIK

SEQ ID NO: 7450 - protein, 6 aa, synthetic construct
  REGION 1..6: note = tagitanlimab light chain CDR1
QSIGTN

SEQ ID NO: 7451 - skipped

SEQ ID NO: 7452 - protein, 9 aa, synthetic construct
  REGION 1..9: note = tagitanlimab light chain CDR3
QQSNSWPYT

SEQ ID NO: 7453 - protein, 122 aa, synthetic construct
  REGION 1..122: note = tamgiblimab heavy chain V region
QVQLVQSGAEVKKPGASVKVSCKASGYTFTEYYMHWVRQAPGQGLEWMGIISPSAGSTKYAQKFQGRVTMTRDTSTSTVYMELSSLRSEDTAVYYCARDHDIRLAGRLADYWGQGTLVTVSS

SEQ ID NO: 7454 - protein, 8 aa, synthetic construct
  REGION 1..8: note = tamgiblimab heavy chain CDR1
GYTFTEYY

SEQ ID NO: 7455 - protein, 9 aa, synthetic construct
  REGION 1..9: note = tamgiblimab heavy chain CDR2
ISPSAGSTK

SEQ ID NO: 7456 - protein, 15 aa, synthetic construct
  REGION 1..15: note = tamgiblimab heavy chain CDR3
ARDHDIRLAGRLADY

SEQ ID NO: 7457 - protein, 107 aa, synthetic construct
  REGION 1..107: note = tamgiblimab light chain V region
DIQMTQSPSSVSASVGDRVTITCRASQGISSWLAWYQQKPGKAPKLLISAASSLQSGVPSRFSGSGSGTDFTLTISSLQPEDFATYYCQQAVILPITFGGGTKVEIK

SEQ ID NO: 7458 - protein, 6 aa, synthetic construct
  REGION 1..6: note = tamgiblimab light chain CDR1
QGISSW

SEQ ID NO: 7459 - skipped

SEQ ID NO: 7460 - protein, 9 aa, synthetic construct
  REGION 1..9: note = tamgiblimab light chain CDR3
QQAVILPIT

SEQ ID NO: 7461 - protein, 115 aa, synthetic construct
  REGION 1..115: note = tarextumab heavy chain V region
EVQLVESGGGLVQPGGSLRLSCAASGFTFSSSGMSWVRQAPGKGLEWVSVIASSGSNTYYADSVKGRFTISRDNSKNTLYLQMNSLRAEDTAVYYCARSIFYTTWGQGTLVTVSS

SEQ ID NO: 7462 - protein, 8 aa, synthetic construct
  REGION 1..8: note = tarextumab heavy chain CDR1
GFTFSSSG

SEQ ID NO: 7463 - protein, 8 aa, synthetic construct
  REGION 1..8: note = tarextumab heavy chain CDR2
IASSGSNT

SEQ ID NO: 7464 - protein, 8 aa, synthetic construct
  REGION 1..8: note = tarextumab heavy chain CDR3
ARSIFYTT

SEQ ID NO: 7465 - protein, 108 aa, synthetic construct
  REGION 1..108: note = tarextumab light chain V region
DIVLTQSPATLSLSPGERATLSCRASQSVRSNYLAWYQQKPGQAPRLLIYGASSRATGVPARFSGSGSGTDFTLTISSLEPEDFAVYYCQQYSNFPITFGQGTKVEIK

SEQ ID NO: 7466 - protein, 7 aa, synthetic construct
  REGION 1..7: note = tarextumab light chain CDR1
QSVRSNY

SEQ ID NO: 7467 - skipped

SEQ ID NO: 7468 - protein, 9 aa, synthetic construct
  REGION 1..9: note = tarextumab light chain CDR3
QQYSNFPIT

SEQ ID NO: 7469 - protein, 118 aa, synthetic construct
  REGION 1..118: note = teprotumumab heavy chain V region
QVELVESGGGVVQPGRSQRLSCAASGFTFSSYGMHWVRQAPGKGLEWVAIIWFDGSSTYYADSVRGRFTISRDNSKNTLYLQMNSLRAEDTAVYFCARELGRRYFDLWGRGTLVSVSS

SEQ ID NO: 7470 - protein, 7 aa, synthetic construct
  REGION 1..7: note = teprotumumab heavy chain CDR1
GFTFSSY

SEQ ID NO: 7471 - protein, 8 aa, synthetic construct
  REGION 1..8: note = teprotumumab heavy chain CDR2
IWFDGSST

SEQ ID NO: 7472 - protein, 11 aa, synthetic construct
  REGION 1..11: note = teprotumumab heavy chain CDR3
ARELGRRYFDL

SEQ ID NO: 7473 - protein, 108 aa, synthetic construct
  REGION 1..108: note = teprotumumab light chain V region
EIVLTQSPATLSLSPGERATLSCRASQSVSSYLAWYQQKPGQAPRLLIYDASKRATGIPARFSGSGSGTDFTLTISSLEPEDFAVYYCQQRSKWPPWTFGQGTKVESK

SEQ ID NO: 7474 - protein, 6 aa, synthetic construct
  REGION 1..6: note = teprotumumab light chain CDR1
QSVSSY

SEQ ID NO: 7475 - skipped

SEQ ID NO: 7476 - protein, 10 aa, synthetic construct
  REGION 1..10: note = teprotumumab light chain CDR3
QQRSKWPPWT

SEQ ID NO: 7477 - protein, 116 aa, synthetic construct
  REGION 1..116: note = tesidolumab heavy chain V region
EVQLVQSGAEVKKPGSSVKVSCKASGGTFSSYAISWVRQAPGQGLEWMGGIGPFFGTANYAQKFQGRVTITADESTSTAYMELSSLRSEDTAVYYCARDTPYFDYWGQGTLVTVSS

SEQ ID NO: 7478 - protein, 8 aa, synthetic construct
  REGION 1..8: note = tesidolumab heavy chain CDR1
GGTFSSYA

SEQ ID NO: 7479 - protein, 8 aa, synthetic construct
  REGION 1..8: note = tesidolumab heavy chain CDR2
IGPFFGTA

SEQ ID NO: 7480 - protein, 9 aa, synthetic construct
  REGION 1..9: note = tesidolumab heavy chain CDR3
ARDTPYFDY

SEQ ID NO: 7481 - protein, 108 aa, synthetic construct
  REGION 1..108: note = tesidolumab light chain V region
SYELTQPLSVSVALGQTARITCSGDSIPNYYVYWYQQKPGQAPVLVIYDDSNRPSGIPERFSGSNSGNTATLTISRAQAGDEADYYCQSFDSSLNAEVFGGGTKLTVL

SEQ ID NO: 7482 - protein, 6 aa, synthetic construct
  REGION 1..6: note = tesidolumab light chain CDR1
SIPNYY

SEQ ID NO: 7483 - skipped

SEQ ID NO: 7484 - protein, 11 aa, synthetic construct
  REGION 1..11: note = tesidolumab light chain CDR3
QSFDSSLNAEV

SEQ ID NO: 7485 - protein, 115 aa, synthetic construct
  REGION 1..115: note = tesnatilimab heavy chain V region
QVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSS

SEQ ID NO: 7486 - protein, 8 aa, synthetic construct
  REGION 1..8: note = tesnatilimab heavy chain CDR1
DDSISSYY

SEQ ID NO: 7487 - protein, 7 aa, synthetic construct
  REGION 1..7: note = tesnatilimab heavy chain CDR2
ISYSGSA

SEQ ID NO: 7488 - protein, 9 aa, synthetic construct
  REGION 1..9: note = tesnatilimab heavy chain CDR3
ANWDDAFNI

SEQ ID NO: 7489 - protein, 108 aa, synthetic construct
  REGION 1..108: note = tesnatilimab light chain V region
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 7490 - protein, 7 aa, synthetic construct
  REGION 1..7: note = tesnatilimab light chain CDR1
QSVSSSY

SEQ ID NO: 7491 - skipped

SEQ ID NO: 7492 - protein, 9 aa, synthetic construct
  REGION 1..9: note = tesnatilimab light chain CDR3
QQYGSSPWT

SEQ ID NO: 7493 - protein, 122 aa, synthetic construct
  REGION 1..122: note = tezepelumab heavy chain V region
QMQLVESGGGVVQPGRSLRLSCAASGFTFRTYGMHWVRQAPGKGLEWVAVIWYDGSNKHYADSVKGRFTITRDNSKNTLNLQMNSLRAEDTAVYYCARAPQWELVHEAFDIWGQGTMVTVSS

SEQ ID NO: 7494 - protein, 8 aa, synthetic construct
  REGION 1..8: note = tezepelumab heavy chain CDR1
GFTFRTYG

SEQ ID NO: 7495 - protein, 8 aa, synthetic construct
  REGION 1..8: note = tezepelumab heavy chain CDR2
IWYDGSNK

SEQ ID NO: 7496 - protein, 15 aa, synthetic construct
  REGION 1..15: note = tezepelumab heavy chain CDR3
ARAPQWELVHEAFDI

SEQ ID NO: 7497 - protein, 108 aa, synthetic construct
  REGION 1..108: note = tezepelumab light chain V region
SYVLTQPPSVSVAPGQTARITCGGNNLGSKSVHWYQQKPGQAPVLVVYDDSDRPSWIPERFSGSNSGNTATLTISRGEAGDEADYYCQVWDSSSDHVVFGGGTKLTVL

SEQ ID NO: 7498 - protein, 6 aa, synthetic construct
  REGION 1..6: note = tezepelumab light chain CDR1
NLGSKS

SEQ ID NO: 7499 - skipped

SEQ ID NO: 7500 - protein, 11 aa, synthetic construct
  REGION 1..11: note = tezepelumab light chain CDR3
QVWDSSSDHVV

SEQ ID NO: 7501 - protein, 117 aa, synthetic construct
  REGION 1..117: note = timolumab heavy chain V region
QVQLVESGGGVVQPGRSLRLSCAASGFTFFSYAMHWVRQTPGKGLEWVAVIWFDGSNENYVDSVKGRFTISRDNSKNTLYLQMNTLRAEDTAVYYCARDAWSYFDYWGQGTLVTVSS

SEQ ID NO: 7502 - protein, 7 aa, synthetic construct
  REGION 1..7: note = timolumab heavy chain CDR1
GFTFFSY

SEQ ID NO: 7503 - protein, 8 aa, synthetic construct
  REGION 1..8: note = timolumab heavy chain CDR2
IWFDGSNE

SEQ ID NO: 7504 - protein, 10 aa, synthetic construct
  REGION 1..10: note = timolumab heavy chain CDR3
ARDAWSYFDY

SEQ ID NO: 7505 - protein, 107 aa, synthetic construct
  REGION 1..107: note = timolumab light chain V region
VIQLTQSPSSLSASVGDRVTITCRASQGISRALAWYQQKPGKGPKLLIYDASSLESGVPSRFSGSGSGTDFTLTISSLQPEDFATYYCQQFNSYPLTFGGGTKVEIK

SEQ ID NO: 7506 - protein, 6 aa, synthetic construct
  REGION 1..6: note = timolumab light chain CDR1
QGISRA

SEQ ID NO: 7507 - skipped

SEQ ID NO: 7508 - protein, 9 aa, synthetic construct
  REGION 1..9: note = timolumab light chain CDR3
QQFNSYPLT

SEQ ID NO: 7509 - protein, 126 aa, synthetic construct
  REGION 1..126: note = tiragolumab heavy chain V region
EVQLQQSGPGLVKPSQTLSLTCAISGDSVSSNSAAWNWIRQSPSRGLEWLGKTYYRFKWYSDYAVSVKGRITINPDTSKNQFSLQLNSVTPEDTAVFYCTRESTTYDLLAGPFDYWGQGTLVTVSS

SEQ ID NO: 7510 - protein, 10 aa, synthetic construct
  REGION 1..10: note = tiragolumab heavy chain CDR1
GDSVSSNSAA

SEQ ID NO: 7511 - protein, 9 aa, synthetic construct
  REGION 1..9: note = tiragolumab heavy chain CDR2
TYYRFKWYS

SEQ ID NO: 7512 - protein, 16 aa, synthetic construct
  REGION 1..16: note = tiragolumab heavy chain CDR3
TRESTTYDLLAGPFDY

SEQ ID NO: 7513 - protein, 113 aa, synthetic construct
  REGION 1..113: note = tiragolumab light chain V region
DIVMTQSPDSLAVSLGERATINCKSSQTVLYSSNNKKYLAWYQQKPGQPPNLLIYWASTRESGVPDRFSGSGSGTDFTLTISSLQAEDVAVYYCQQYYSTPFTFGPGTKVEIK

SEQ ID NO: 7514 - protein, 12 aa, synthetic construct
  REGION 1..12: note = tiragolumab light chain CDR1
QTVLYSSNNKKY

SEQ ID NO: 7515 - skipped

SEQ ID NO: 7516 - protein, 9 aa, synthetic construct
  REGION 1..9: note = tiragolumab light chain CDR3
QQYYSTPFT

SEQ ID NO: 7517 - protein, 118 aa, synthetic construct
  REGION 1..118: note = tisotumab heavy chain V region
EVQLLESGGGLVQPGGSLRLSCAASGFTFSNYAMSWVRQAPGKGLEWVSSISGSGDYTYYTDSVKGRFTISRDNSKNTLYLQMNSLRAEDTAVYYCARSPWGYYLDSWGQGTLVTVSS

SEQ ID NO: 7518 - protein, 7 aa, synthetic construct
  REGION 1..7: note = tisotumab heavy chain CDR1
GFTFSNY

SEQ ID NO: 7519 - protein, 8 aa, synthetic construct
  REGION 1..8: note = tisotumab heavy chain CDR2
ISGSGDYT

SEQ ID NO: 7520 - protein, 11 aa, synthetic construct
  REGION 1..11: note = tisotumab heavy chain CDR3
ARSPWGYYLDS

SEQ ID NO: 7521 - protein, 107 aa, synthetic construct
  REGION 1..107: note = tisotumab light chain V region
DIQMTQSPPSLSASAGDRVTITCRASQGISSRLAWYQQKPEKAPKSLIYAASSLQSGVPSRFSGSGSGTDFTLTISSLQPEDFATYYCQQYNSYPYTFGQGTKLEIK

SEQ ID NO: 7522 - protein, 6 aa, synthetic construct
  REGION 1..6: note = tisotumab light chain CDR1
QGISSR

SEQ ID NO: 7523 - skipped

SEQ ID NO: 7524 - protein, 9 aa, synthetic construct
  REGION 1..9: note = tisotumab light chain CDR3
QQYNSYPYT

SEQ ID NO: 7525 - protein, 118 aa, synthetic construct; identical to SEQ ID NO: 7517
  REGION 1..118: note = tisotumab vedotin heavy chain V region

SEQ ID NO: 7526 - protein, 8 aa, synthetic construct
  REGION 1..8: note = tisotumab vedotin heavy chain CDR1
GFTFSNYA

SEQ ID NO: 7527 - protein, 8 aa, synthetic construct
  REGION 1..8: note = tisotumab vedotin heavy chain CDR2
ISGSGDYT

SEQ ID NO: 7528 - protein, 11 aa, synthetic construct
  REGION 1..11: note = tisotumab vedotin heavy chain CDR3
ARSPWGYYLDS

SEQ ID NO: 7529 - protein, 107 aa, synthetic construct; identical to SEQ ID NO: 7521
  REGION 1..107: note = tisotumab vedotin light chain V region

SEQ ID NO: 7530 - protein, 6 aa, synthetic construct
  REGION 1..6: note = tisotumab vedotin light chain CDR1
QGISSR

SEQ ID NO: 7531 - skipped

SEQ ID NO: 7532 - protein, 9 aa, synthetic construct
  REGION 1..9: note = tisotumab vedotin light chain CDR3
QQYNSYPYT

SEQ ID NO: 7533 - protein, 123 aa, synthetic construct; identical to SEQ ID NO: 452
  REGION 1..123: note = tixavimab heavy chain V region

SEQ ID NO: 7534 - protein, 8 aa, synthetic construct
  REGION 1..8: note = tixavimab heavy chain CDR1
GFTFMSSA

SEQ ID NO: 7535 - protein, 8 aa, synthetic construct
  REGION 1..8: note = tixavimab heavy chain CDR2
IVIGSGNT

SEQ ID NO: 7536 - protein, 16 aa, synthetic construct
  REGION 1..16: note = tixavimab heavy chain CDR3
AAPYCSSISCNDGFDI

SEQ ID NO: 7537 - protein, 109 aa, synthetic construct; identical to SEQ ID NO: 451
  REGION 1..109: note = tixavimab light chain V region

SEQ ID NO: 7538 - protein, 7 aa, synthetic construct
  REGION 1..7: note = tixavimab light chain CDR1
QSVSSSY

SEQ ID NO: 7539 - skipped

SEQ ID NO: 7540 - protein, 10 aa, synthetic construct
  REGION 1..10: note = tixavimab light chain CDR3
QHYGSSRGWT

SEQ ID NO: 7541 - protein, 119 aa, synthetic construct [sequence omitted]

SEQ ID NO: 7542 - protein, 9 aa, synthetic construct
  REGION 1..9: note = tocilizumab heavy chain CDR1
GYSITSDHA

SEQ ID NO: 7543 - protein, 7 aa, synthetic construct
  REGION 1..7: note = tocilizumab heavy chain CDR2
ISYSGIT

SEQ ID NO: 7544 - protein, 12 aa, synthetic construct
  REGION 1..12: note = tocilizumab heavy chain CDR3
ARSLARTTAMDY

SEQ ID NO: 7545 - protein, 107 aa, synthetic construct [sequence omitted]

SEQ ID NO: 7546 - protein, 6 aa, synthetic construct
  REGION 1..6: note = tocilizumab light chain CDR1
QDISSY

SEQ ID NO: 7547 - skipped

SEQ ID NO: 7548 - protein, 9 aa, synthetic construct
  REGION 1..9: note = tocilizumab light chain CDR3
QQGNTLPYT

SEQ ID NO: 7549 - protein, 121 aa, synthetic construct
  REGION 1..121: note = tosatoxumab heavy chain V region
EVQMVQSGAEVKKPGEPLKISCKGSGYKFGTHWIGWVRQRPGKGLEWMGIIHPADSETKYSPSFQGQVSFSADKSSNTAYLHWSTLRASDTAMYYCARRSGSSSWYALDFWGQGTMVTVSS

SEQ ID NO: 7550 - protein, 8 aa, synthetic construct
  REGION 1..8: note = tosatoxumab heavy chain CDR1
GYKFGTHW

SEQ ID NO: 7551 - protein, 8 aa, synthetic construct
  REGION 1..8: note = tosatoxumab heavy chain CDR2
IHPADSET

SEQ ID NO: 7552 - protein, 14 aa, synthetic construct
  REGION 1..14: note = tosatoxumab heavy chain CDR3
ARRSGSSSWYALDF

SEQ ID NO: 7553 - protein, 111 aa, synthetic construct
  REGION 1..111: note = tosatoxumab light chain V region
QSVLTQSPSASGTPGQRVTISCSGGSSNIGSNTVNWYQQFPGAAPKLLIYTNNQRPSGVPDRFSGSKSGTSASLAISGLQSEDEADYYCATWDDSLNGLYVFGTGTKVTVL

SEQ ID NO: 7554 - protein, 8 aa, synthetic construct
  REGION 1..8: note = tosatoxumab light chain CDR1
SSNIGSNT

SEQ ID NO: 7555 - skipped

SEQ ID NO: 7556 - protein, 12 aa, synthetic construct
  REGION 1..12: note = tosatoxumab light chain CDR3
ATWDDSLNGLYV

SEQ ID NO: 7557 - protein, 120 aa, synthetic construct
  REGION 1..120: note = tovetumab heavy chain V region
QVQLVESGGGLVKPGGSLRLSCAASGFTFSDYYMNWIRQAPGKGLEWVSYISSSGSIIYYADSVKGRFTISRDNAKNSLYLQMNSLRAEDTAVYYCAREGRIAARGMDVWGQGTTVTVSS

SEQ ID NO: 7558 - protein, 7 aa, synthetic construct
  REGION 1..7: note = tovetumab heavy chain CDR1
GFTFSDY

SEQ ID NO: 7559 - protein, 8 aa, synthetic construct
  REGION 1..8: note = tovetumab heavy chain CDR2
ISSSGSII

SEQ ID NO: 7560 - protein, 13 aa, synthetic construct
  REGION 1..13: note = tovetumab heavy chain CDR3
AREGRIAARGMDV

SEQ ID NO: 7561 - protein, 108 aa, synthetic construct
  REGION 1..108: note = tovetumab light chain V region
DIQMTQSPSSLSASVGDRVSITCRPSQSFSRYINWYQQKPGKAPKLLIHAASSLVGGVPSRFSGSGSGTDFTLTISSLQPEDFATYYCQQTYSNPPITFGQGTRLEMK

SEQ ID NO: 7562 - protein, 6 aa, synthetic construct
  REGION 1..6: note = tovetumab light chain CDR1
QSFSRY

SEQ ID NO: 7563 - skipped

SEQ ID NO: 7564 - protein, 10 aa, synthetic construct
  REGION 1..10: note = tovetumab light chain CDR3
QQTYSNPPIT

SEQ ID NO: 7565 - protein, 126 aa, synthetic construct
  REGION 1..126: note = tozorakimab heavy chain V region
EVQLLESGGGLVQPGGSLRLSCAASGFTFSSYAMSWVRQAPGKGLEWVSGISAIDQSTYYADSVKGRFTISRDNSKNTLYLQMNSLRAEDTAVYYCARQKFMQLWGGGLRYPFGYWGQGTMVTVSS

SEQ ID NO: 7566 - protein, 8 aa, synthetic construct
  REGION 1..8: note = tozorakimab heavy chain CDR1
GFTFSSYA

SEQ ID NO: 7567 - protein, 8 aa, synthetic construct
  REGION 1..8: note = tozorakimab heavy chain CDR2
ISAIDQST

SEQ ID NO: 7568 - protein, 19 aa, synthetic construct
  REGION 1..19: note = tozorakimab heavy chain CDR3
ARQKFMQLWGGGLRYPFGY

SEQ ID NO: 7569 - protein, 106 aa, synthetic construct
  REGION 1..106: note = tozorakimab light chain V region
SYVLTQPPSVSVSPGQTASITCSGEGMGDKYAAWYQQKPGQSPVLVIYRDTKRPSGIPERFSGSNSGNTATLTISGTQAMDEADYYCGVIQDNTGVFGGGTKLTVL

SEQ ID NO: 7570 - protein, 6 aa, synthetic construct
  REGION 1..6: note = tozorakimab light chain CDR1
GMGDKY

SEQ ID NO: 7571 - skipped

SEQ ID NO: 7572 - protein, 9 aa, synthetic construct
  REGION 1..9: note = tozorakimab light chain CDR3
GVIQDNTGV

SEQ ID NO: 7573 - protein, 122 aa, synthetic construct
  REGION 1..122: note = tralokinumab heavy chain V region
QVQLVQSGAEVKKPGASVKVSCKASGYTFTNYGLSWVRQAPGQGLEWMGWISANNGDTNYGQEFQGRVTMTTDTSTSTAYMELRSLRSDDTAVYYCARDSSSSWARWFFDLWGRGTLVTVSS

SEQ ID NO: 7574 - protein, 8 aa, synthetic construct
  REGION 1..8: note = tralokinumab heavy chain CDR1
GYTFTNYG

SEQ ID NO: 7575 - protein, 8 aa, synthetic construct
  REGION 1..8: note = tralokinumab heavy chain CDR2
ISANNGDT

SEQ ID NO: 7576 - protein, 15 aa, synthetic construct
  REGION 1..15: note = tralokinumab heavy chain CDR3
ARDSSSSWARWFFDL

SEQ ID NO: 7577 - protein, 108 aa, synthetic construct
  REGION 1..108: note = tralokinumab light chain V region
SYVLTQPPSVSVAPGKTARITCGGNIIGSKLVHWYQQKPGQAPVLVIYDDGDRPSGIPERFSGSNSGNTATLTISRVEAGDEADYYCQVWDTGSDPVVFGGGTKLTVL

SEQ ID NO: 7578 - protein, 6 aa, synthetic construct
  REGION 1..6: note = tralokinumab light chain CDR1
IIGSKL

SEQ ID NO: 7579 - skipped

SEQ ID NO: 7580 - protein, 11 aa, synthetic construct
  REGION 1..11: note = tralokinumab light chain CDR3
QVWDTGSDPVV

SEQ ID NO: 7581 - protein, 120 aa, synthetic construct [sequence omitted]

SEQ ID NO: 7582 - protein, 8 aa, synthetic construct
  REGION 1..8: note = trastuzumab heavy chain CDR1
GFNIKDTY

SEQ ID NO: 7583 - protein, 8 aa, synthetic construct
  REGION 1..8: note = trastuzumab heavy chain CDR2
IYPTNGYT

SEQ ID NO: 7584 - protein, 13 aa, synthetic construct
  REGION 1..13: note = trastuzumab heavy chain CDR3
SRWGGDGFYAMDY

SEQ ID NO: 7585 - protein, 107 aa, synthetic construct [sequence omitted]

SEQ ID NO: 7586 - protein, 6 aa, synthetic construct
  REGION 1..6: note = trastuzumab light chain CDR1
QDVNTA

SEQ ID NO: 7587 - skipped

SEQ ID NO: 7588 - protein, 9 aa, synthetic construct
  REGION 1..9: note = trastuzumab light chain CDR3
QQHYTTPPT

SEQ ID NO: 7589 - protein, 125 aa, synthetic construct
  REGION 1..125: note = tremelimumab heavy chain V region
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYYGMDVWGQGTTVTVSS

SEQ ID NO: 7590 - protein, 8 aa, synthetic construct
  REGION 1..8: note = tremelimumab heavy chain CDR1
GFTFSSYG

SEQ ID NO: 7591 - protein, 8 aa, synthetic construct
  REGION 1..8: note = tremelimumab heavy chain CDR2
IWYDGSNK

SEQ ID NO: 7592 - protein, 18 aa, synthetic construct
  REGION 1..18: note = tremelimumab heavy chain CDR3
ARDPRGATLYYYYYGMDV

SEQ ID NO: 7593 - protein, 107 aa, synthetic construct
  REGION 1..107: note = tremelimumab light chain V region
DIQMTQSPSSLSASVGDRVTITCRASQSINSYLDWYQQKPGKAPKLLIYAASSLQSGVPSRFSGSGSGTDFTLTISSLQPEDFATYYCQQYYSTPFTFGPGTKVEIK

SEQ ID NO: 7594 - protein, 6 aa, synthetic construct
  REGION 1..6: note = tremelimumab light chain CDR1
QSINSY

SEQ ID NO: 7595 - skipped

SEQ ID NO: 7596 - protein, 9 aa, synthetic construct
  REGION 1..9: note = tremelimumab light chain CDR3
QQYYSTPFT

SEQ ID NO: 7597 - protein, 120 aa, synthetic construct
  REGION 1..120: note = trevogrumab heavy chain V region
EVQVLESGGDLVQPGGSLRLSCAASGFTFSAYAMTWVRQAPGKGLEWVSAISGSGGSAYYADSVKGRFTISRDNSKNTVYLQMNSLRAEDTAVYYCAKDGAWKMSGLDVWGQGTTVIVSS

SEQ ID NO: 7598 - protein, 8 aa, synthetic construct
  REGION 1..8: note = trevogrumab heavy chain CDR1
GFTFSAYA

SEQ ID NO: 7599 - protein, 8 aa, synthetic construct
  REGION 1..8: note = trevogrumab heavy chain CDR2
ISGSGGSA

SEQ ID NO: 7600 - protein, 13 aa, synthetic construct
  REGION 1..13: note = trevogrumab heavy chain CDR3
AKDGAWKMSGLDV

SEQ ID NO: 7601 - protein, 107 aa, synthetic construct
  REGION 1..107: note = trevogrumab light chain V region
DIQMTQSPASLSASVGDRVTITCRASQDISDYLAWYQQKPGKIPRLLIYTTSTLQSGVPSRFRGSGSGTDFTLTISSLQPEDVATYYCQKYDSAPLTFGGGTKVEIK

SEQ ID NO: 7602 - protein, 6 aa, synthetic construct
  REGION 1..6: note = trevogrumab light chain CDR1
QDISDY

SEQ ID NO: 7603 - skipped

SEQ ID NO: 7604 - protein, 9 aa, synthetic construct
  REGION 1..9: note = trevogrumab light chain CDR3
QKYDSAPLT

SEQ ID NO: 7605 - protein, 118 aa, synthetic construct
  REGION 1..118: note = tuvonralimab heavy chain V region
QVQLVESGGGVVEPGRSLRLSCAASGFTFSSYGMHWVRQAPGKGLEWVAVIWYKPSEKDYADSAKGRFTISRDNSKNTLYLQMNSLRAEDTAVYYCARGGLLGYFDYWGQGTLVTVSS

SEQ ID NO: 7606 - protein, 7 aa, synthetic construct
  REGION 1..7: note = tuvonralimab heavy chain CDR1
GFTFSSY

SEQ ID NO: 7607 - protein, 8 aa, synthetic construct
  REGION 1..8: note = tuvonralimab heavy chain CDR2
IWYKPSEK

SEQ ID NO: 7608 - protein, 11 aa, synthetic construct
  REGION 1..11: note = tuvonralimab heavy chain CDR3
ARGGLLGYFDY

SEQ ID NO: 7609 - protein, 107 aa, synthetic construct
  REGION 1..107: note = tuvonralimab light chain V region
EIVLTQSPGTLSLSPGERATLSCRASQSINSYLAWYQQKPGQAPRPLIYGVSSRATGIPDRFSGSGSGTDFTLTISRLEPEDFAVYYCQQYGRYPFTFGPGTKVDIK

SEQ ID NO: 7610 - protein, 6 aa, synthetic construct
  REGION 1..6: note = tuvonralimab light chain CDR1
QSINSY

SEQ ID NO: 7611 - skipped

SEQ ID NO: 7612 - protein, 9 aa, synthetic construct
  REGION 1..9: note = tuvonralimab light chain CDR3
QQYGRYPFT

SEQ ID NO: 7613 - protein, 118 aa, synthetic construct
  REGION 1..118: note = ublituximab heavy chain V region
QAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSS

SEQ ID NO: 7614 - protein, 8 aa, synthetic construct
  REGION 1..8: note = ublituximab heavy chain CDR1
GYTFTSYN

SEQ ID NO: 7615 - protein, 8 aa, synthetic construct
  REGION 1..8: note = ublituximab heavy chain CDR2
IYPGNGDT

SEQ ID NO: 7616 - protein, 11 aa, synthetic construct
  REGION 1..11: note = ublituximab heavy chain CDR3
ARYDYNYAMDY

SEQ ID NO: 7617 - protein, 106 aa, synthetic construct
  REGION 1..106: note = ublituximab light chain V region
QIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIK

SEQ ID NO: 7618 - protein, 5 aa, synthetic construct
  REGION 1..5: note = ublituximab light chain CDR1
SSVSY

SEQ ID NO: 7619 - skipped

SEQ ID NO: 7620 - protein, 9 aa, synthetic construct
  REGION 1..9: note = ublituximab light chain CDR3
QQWTFNPPT

SEQ ID NO: 7621 - protein, 125 aa, synthetic construct
  REGION 1..125: note = ulocuplumab heavy chain V region
EVQLVESGGGLVQPGGSLRLSCAAAGFTFSSYSMNWVRQAPGKGLEWVSYISSRSRTIYYADSVKGRFTISRDNAKNSLYLQMNSLRDEDTAVYYCARDYGGQPPYYYYYGMDVWGQGTTVTVSS

SEQ ID NO: 7622 - protein, 8 aa, synthetic construct
  REGION 1..8: note = ulocuplumab heavy chain CDR1
GFTFSSYS

SEQ ID NO: 7623 - protein, 8 aa, synthetic construct
  REGION 1..8: note = ulocuplumab heavy chain CDR2
ISSRSRTI

SEQ ID NO: 7624 - protein, 18 aa, synthetic construct
  REGION 1..18: note = ulocuplumab heavy chain CDR3
ARDYGGQPPYYYYYGMDV

SEQ ID NO: 7625 - protein, 107 aa, synthetic construct
  REGION 1..107: note = ulocuplumab light chain V region
DIQMTQSPSSLSASVGDRVTITCRASQGISSWLAWYQQKPEKAPKSLIYAASSLQSGVPSRFSGSGSGTDFTLTISSLQPEDFVTYYCQQYNSYPRTFGQGTKVEIK

SEQ ID NO: 7626 - protein, 6 aa, synthetic construct
  REGION 1..6: note = ulocuplumab light chain CDR1
QGISSW

SEQ ID NO: 7627 - skipped

SEQ ID NO: 7628 - protein, 9 aa, synthetic construct
  REGION 1..9: note = ulocuplumab light chain CDR3
QQYNSYPRT

SEQ ID NO: 7629 - protein, 125 aa, synthetic construct
  REGION 1..125: note = urabrelimab heavy chain V region
QVQLQESGPGLVKPSGTLSLTCAVSGVSIRSINWWNWVRQPPGKGLEWIGEIYHSGSTNYNPSLKSRVTISVDKSKNQFSLKLNSVTAADTAVYYCARDGGIAVTDYYYYGLDVWGQGTTVTVSS

SEQ ID NO: 7630 - protein, 9 aa, synthetic construct
  REGION 1..9: note = urabrelimab heavy chain CDR1
GVSIRSINW

SEQ ID NO: 7631 - protein, 7 aa, synthetic construct
  REGION 1..7: note = urabrelimab heavy chain CDR2
IYHSGST

SEQ ID NO: 7632 - protein, 18 aa, synthetic construct
  REGION 1..18: note = urabrelimab heavy chain CDR3
ARDGGIAVTDYYYYGLDV

SEQ ID NO: 7633 - protein, 106 aa, synthetic construct
  REGION 1..106: note = urabrelimab light chain V region
EIVLTQSPATLSLSPGERATLSCRASESVSSNLAWYQQKPGQAPRLLIYGAFNRATGIPARFSGSGSGTDFTLTISSLEPEDFAVYYCQQRSDWFTFGGGTKVEIK

SEQ ID NO: 7634 - protein, 6 aa, synthetic construct
  REGION 1..6: note = urabrelimab light chain CDR1
ESVSSN

SEQ ID NO: 7635 - skipped

SEQ ID NO: 7636 - protein, 8 aa, synthetic construct
  REGION 1..8: note = urabrelimab light chain CDR3
QQRSDWFT

SEQ ID NO: 7637 - protein, 121 aa, synthetic construct [sequence omitted]

SEQ ID NO: 7638 - protein, 8 aa, synthetic construct
  REGION 1..8: note = urelumab heavy chain CDR1
GGSFSGYY

SEQ ID NO: 7639 - protein, 7 aa, synthetic construct
  REGION 1..7: note = urelumab heavy chain CDR2
INHGGYV

SEQ ID NO: 7640 - protein, 15 aa, synthetic construct
  REGION 1..15: note = urelumab heavy chain CDR3
ARDYGPGNYDWYFDL

SEQ ID NO: 7641 - protein, 109 aa, synthetic construct
  REGION 1..109: note = urelumab light chain V region
EIVLTQSPATLSLSPGERATLSCRASQSVSSYLAWYQQKPGQAPRLLIYDASNRATGIPARFSGSGSGTDFTLTISSLEPEDFAVYYCQQRSNWPPALTFCGGTKVEIK

SEQ ID NO: 7642 - protein, 6 aa, synthetic construct
  REGION 1..6: note = urelumab light chain CDR1
QSVSSY

SEQ ID NO: 7643 - skipped

SEQ ID NO: 7644 - protein, 13 aa, synthetic construct
  REGION 1..13: note = urelumab light chain CDR3
QQRSNWPPALTFC

SEQ ID NO: 7645 - protein, 119 aa, synthetic construct
  REGION 1..119: note = ustekinumab heavy chain V region
EVQLVQSGAEVKKPGESLKISCKGSGYSFTTYWLGWVRQMPGKGLDWIGIMSPVDSDIRYSPSFQGQVTMSVDKSITTAYLQWNSLKASDTAMYYCARRRPGQGYFDFWGQGTLVTVSS

SEQ ID NO: 7646 - protein, 8 aa, synthetic construct
  REGION 1..8: note = ustekinumab heavy chain CDR1
GYSFTTYW

SEQ ID NO: 7647 - protein, 8 aa, synthetic construct
  REGION 1..8: note = ustekinumab heavy chain CDR2
MSPVDSDI

SEQ ID NO: 7648 - protein, 12 aa, synthetic construct
  REGION 1..12: note = ustekinumab heavy chain CDR3
ARRRPGQGYFDF

SEQ ID NO: 7649 - protein, 107 aa, synthetic construct
  REGION 1..107: note = ustekinumab light chain V region
DIQMTQSPSSLSASVGDRVTITCRASQGISSWLAWYQQKPEKAPKSLIYAASSLQSGVPSRFSGSGSGTDFTLTISSLQPEDFATYYCQQYNIYPYTFGQGTKLEIK

SEQ ID NO: 7650 - protein, 6 aa, synthetic construct
  REGION 1..6: note = ustekinumab light chain CDR1
QGISSW

SEQ ID NO: 7651 - skipped

SEQ ID NO: 7652 - protein, 9 aa, synthetic construct
  REGION 1..9: note = ustekinumab light chain CDR3
QQYNIYPYT

SEQ ID NO: 7653 - protein, 116 aa, synthetic construct
  REGION 1..116: note = utomilumab heavy chain V region
EVQLVQSGAEVKKPGESLRISCKGSGYSFSTYWISWVRQMPGKGLEWMGKIYPGDSYTNYSPSFQGQVTISADKSISTAYLQWSSLKASDTAMYYCARGYGIFDYWGQGTLVTVSS

SEQ ID NO: 7654 - protein, 8 aa, synthetic construct
  REGION 1..8: note = utomilumab heavy chain CDR1
GYSFSTYW

SEQ ID NO: 7655 - protein, 8 aa, synthetic construct
  REGION 1..8: note = utomilumab heavy chain CDR2
IYPGDSYT

SEQ ID NO: 7656 - protein, 9 aa, synthetic construct
  REGION 1..9: note = utomilumab heavy chain CDR3
ARGYGIFDY

SEQ ID NO: 7657 - protein, 108 aa, synthetic construct
  REGION 1..108: note = utomilumab light chain V region
SYELTQPPSVSVSPGQTASITCSGDNIGDQYAHWYQQKPGQSPVLVIYQDKNRPSGIPERFSGSNSGNTATLTISGTQAMDEADYYCATYTGFGSLAVFGGGTKLTVL

SEQ ID NO: 7658 - protein, 6 aa, synthetic construct
  REGION 1..6: note = utomilumab light chain CDR1
NIGDQY

SEQ ID NO: 7659 - skipped

SEQ ID NO: 7660 - protein, 11 aa, synthetic construct
  REGION 1..11: note = utomilumab light chain CDR3
ATYTGFGSLAV

SEQ ID NO: 7661 - protein, 118 aa, synthetic construct
  REGION 1..118: note = vantictumab heavy chain V region
EVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSS

SEQ ID NO: 7662 - protein, 8 aa, synthetic construct
  REGION 1..8: note = vantictumab heavy chain CDR1
GFTFSHYT

SEQ ID NO: 7663 - protein, 8 aa, synthetic construct
  REGION 1..8: note = vantictumab heavy chain CDR2
ISGDGSYT

SEQ ID NO: 7664 - protein, 11 aa, synthetic construct
  REGION 1..11: note = vantictumab heavy chain CDR3
ARNFIKYVFAN

SEQ ID NO: 7665 - protein, 107 aa, synthetic construct
  REGION 1..107: note = vantictumab light chain V region
DIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVL

SEQ ID NO: 7666 - protein, 6 aa, synthetic construct
  REGION 1..6: note = vantictumab light chain CDR1
NIGSFY

SEQ ID NO: 7667 - skipped

SEQ ID NO: 7668 - protein, 10 aa, synthetic construct
  REGION 1..10: note = vantictumab light chain CDR3
QSYANTLSLV

SEQ ID NO: 7669 - protein, 126 aa, synthetic construct
  REGION 1..126: note = varisacumab heavy chain V region
QVQLVQSGAEVKKPGASVKVSCKASGGTFSSYAISWVRQAPGQGLEWMGGFDPEDGETIYAQKFQGRVTMTEDTSTDTAYMELSSLRSEDTAVYYCATGRSMVRGVIIPFNGMDVWGQGTTVTVSS

SEQ ID NO: 7670 - protein, 8 aa, synthetic construct
  REGION 1..8: note = varisacumab heavy chain CDR1
GGTFSSYA

SEQ ID NO: 7671 - protein, 8 aa, synthetic construct
  REGION 1..8: note = varisacumab heavy chain CDR2
FDPEDGET

SEQ ID NO: 7672 - protein, 19 aa, synthetic construct
  REGION 1..19: note = varisacumab heavy chain CDR3
ATGRSMVRGVIIPFNGMDV

SEQ ID NO: 7673 - protein, 107 aa, synthetic construct
  REGION 1..107: note = varisacumab light chain V region
DIRMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 7674 - protein, 6 aa, synthetic construct
  REGION 1..6: note = varisacumab light chain CDR1
QSISSY

SEQ ID NO: 7675 - skipped

SEQ ID NO: 7676 - protein, 9 aa, synthetic construct
  REGION 1..9: note = varisacumab light chain CDR3
QQSYSTPLT

SEQ ID NO: 7677 - protein, 119 aa, synthetic construct
  REGION 1..119: note = varlilumab heavy chain V region
QVQLVESGGGVVQPGRSLRLSCAASGFTFSSYDMHWVRQAPGKGLEWVAVIWYDGSNKYYADSVKGRFTISRDNSKNTLYLQMNSLRAEDTAVYYCARGSGNWGFFDYWGQGTLVTVSS

SEQ ID NO: 7678 - protein, 8 aa, synthetic construct
  REGION 1..8: note = varlilumab heavy chain CDR1
GFTFSSYD

SEQ ID NO: 7679 - protein, 8 aa, synthetic construct
  REGION 1..8: note = varlilumab heavy chain CDR2
IWYDGSNK

SEQ ID NO: 7680 - protein, 12 aa, synthetic construct
  REGION 1..12: note = varlilumab heavy chain CDR3
ARGSGNWGFFDY

SEQ ID NO: 7681 - protein, 107 aa, synthetic construct
  REGION 1..107: note = varlilumab light chain V region
DIQMTQSPSSLSASVGDRVTITCRASQGISRWLAWYQQKPEKAPKSLIYAASSLQSGVPSRFSGSGSGTDFTLTISSLQPEDFATYYCQQYNTYPRTFGQGTKVEIK

SEQ ID NO: 7682 - protein, 6 aa, synthetic construct
  REGION 1..6: note = varlilumab light chain CDR1
QGISRW

SEQ ID NO: 7683 - skipped

SEQ ID NO: 7684 - protein, 9 aa, synthetic construct
  REGION 1..9: note = varlilumab light chain CDR3
QQYNTYPRT

SEQ ID NO: 7685 - protein, 121 aa, synthetic construct [sequence omitted]

SEQ ID NO: 7686 - protein, 8 aa, synthetic construct
  REGION 1..8: note = vedolizumab heavy chain CDR1
GYTFTSYW

SEQ ID NO: 7687 - protein, 8 aa, synthetic construct
  REGION 1..8: note = vedolizumab heavy chain CDR2
IDPSESNT

SEQ ID NO: 7688 - protein, 14 aa, synthetic construct
  REGION 1..14: note = vedolizumab heavy chain CDR3
ARGGYDGWDYAIDY

SEQ ID NO: 7689 - protein, 112 aa, synthetic construct [sequence omitted]

SEQ ID NO: 7690 - protein, 11 aa, synthetic construct
  REGION 1..11: note = vedolizumab light chain CDR1
QSLAKSYGNTY

SEQ ID NO: 7691 - skipped

SEQ ID NO: 7692 - protein, 9 aa, synthetic construct
  REGION 1..9: note = vedolizumab light chain CDR3
LQGTHQPYT

SEQ ID NO: 7693 - protein, 123 aa, synthetic construct [sequence omitted]

SEQ ID NO: 7694 - protein, 8 aa, synthetic construct
  REGION 1..8: note = vesencumab heavy chain CDR1
GFTFSSYA

SEQ ID NO: 7695 - protein, 8 aa, synthetic construct
  REGION 1..8: note = vesencumab heavy chain CDR2
ISPAGGYT

SEQ ID NO: 7696 - protein, 16 aa, synthetic construct
  REGION 1..16: note = vesencumab heavy chain CDR3
ARGELPYYRMSKVMDV

SEQ ID NO: 7697 - protein, 107 aa, synthetic construct
  REGION 1..107: note = vesencumab light chain V region
DIQMTQSPSSLSASVGDRVTITCRASQYFSSYLAWYQQKPGKAPKLLIYGASSRASGVPSRFSGSGSGTDFTLTISSLQPEDFATYYCQQYLGSPPTFGQGTKVEIK

SEQ ID NO: 7698 - protein, 6 aa, synthetic construct
  REGION 1..6: note = vesencumab light chain CDR1
QYFSSY

SEQ ID NO: 7699 - skipped

SEQ ID NO: 7700 - protein, 9 aa, synthetic construct
  REGION 1..9: note = vesencumab light chain CDR3
QQYLGSPPT

SEQ ID NO: 7701 - protein, 126 aa, synthetic construct
  REGION 1..126: note = vixarelimab heavy chain V region
QVQLVQSGAEVKKPGASVKVSCKASGYTFTSYEINWVRQATGQGLEWMGWMNPNSGYTGYAQKFQGRVTMTRDTSISTAYMEMSSLRSEDTAVYYCARDIVAANTDYYFYYGMDVWGQGTTVTVSS

SEQ ID NO: 7702 - protein, 8 aa, synthetic construct
  REGION 1..8: note = vixarelimab heavy chain CDR1
GYTFTSYE

SEQ ID NO: 7703 - protein, 8 aa, synthetic construct
  REGION 1..8: note = vixarelimab heavy chain CDR2
MNPNSGYT

SEQ ID NO: 7704 - protein, 19 aa, synthetic construct
  REGION 1..19: note = vixarelimab heavy chain CDR3
ARDIVAANTDYYFYYGMDV

SEQ ID NO: 7705 - protein, 110 aa, synthetic construct
  REGION 1..110: note = vixarelimab light chain V region
QSVLTQPPSASGTPGQRVTISCSGSNSNIGSNTVNWYHQLPGTAPKLLIYNINKRPSGVPDRFSGSKSGSSASLAISGLQSEDEADYYCSTWDDSLDGVVFGGGTKLTVL

SEQ ID NO: 7706 - protein, 8 aa, synthetic construct
  REGION 1..8: note = vixarelimab light chain CDR1
NSNIGSNT

SEQ ID NO: 7707 - skipped

SEQ ID NO: 7708 - protein, 11 aa, synthetic construct
  REGION 1..11: note = vixarelimab light chain CDR3
STWDDSLDGVV

SEQ ID NO: 7709 - protein, 128 aa, synthetic construct
  REGION 1..128: note = volagidemab heavy chain V region
QVQLVESGGGVVQPGRSLRLSCAASGFTFSSYGMHWVRQAPGKGLEWVAVMWYDGSNKDYVDSVKGRFTISRDNSKNTLYLQMNRLRAEDTAVYYCAREKDHYDILTGYNYYYGLDVWGQGTTVTVSS

SEQ ID NO: 7710 - protein, 8 aa, synthetic construct
  REGION 1..8: note = volagidemab heavy chain CDR1
GFTFSSYG

SEQ ID NO: 7711 - protein, 8 aa, synthetic construct
  REGION 1..8: note = volagidemab heavy chain CDR2
MWYDGSNK

SEQ ID NO: 7712 - protein, 21 aa, synthetic construct
  REGION 1..21: note = volagidemab heavy chain CDR3
AREKDHYDILTGYNYYYGLDV

SEQ ID NO: 7713 - protein, 107 aa, synthetic construct
  REGION 1..107: note = volagidemab light chain V region
DIQMTQSPSSLSASVGDRVTITCRASQGIRNDLGWYQQKPGKAPKRLIYAASSLQSGVPSRFSGSGSGTEFTLTISSVQPEDFVTYYCLQHNSNPLTFGGGTKVEIK

SEQ ID NO: 7714 - protein, 6 aa, synthetic construct
  REGION 1..6: note = volagidemab light chain CDR1
QGIRND

SEQ ID NO: 7715 - skipped

SEQ ID NO: 7716 - protein, 9 aa, synthetic construct
  REGION 1..9: note = volagidemab light chain CDR3
LQHNSNPLT

SEQ ID NO: 7717 - protein, 117 aa, synthetic construct
  REGION 1..117: note = vulinacimab heavy chain V region
QVQLVQSGGGLVQPGGSLRLSCAASGFSFSTYAMSWVRQAPGKGLEWVSGISGSGGTTHYADSVKGRFTISRDNSKNTVNLQMNSLRAEDTAVYYCAKGLWFGEGLWGQGTLVTVSS

SEQ ID NO: 7718 - protein, 8 aa, synthetic construct
  REGION 1..8: note = vulinacimab heavy chain CDR1
GFSFSTYA

SEQ ID NO: 7719 - protein, 8 aa, synthetic construct
  REGION 1..8: note = vulinacimab heavy chain CDR2
ISGSGGTT

SEQ ID NO: 7720 - protein, 10 aa, synthetic construct
  REGION 1..10: note = vulinacimab heavy chain CDR3
AKGLWFGEGL

SEQ ID NO: 7721 - protein, 112 aa, synthetic construct
  REGION 1..112: note = vulinacimab light chain V region
DVVMTQSPLSLPVTLGQPASISCRSSQSLYYRSGYTFLDWYVQKPGQSPQLLIYQSSKRDSGVPDRISGSGSGTDFTLRISRVEAEDVGVYYCFQGTHWPYTFGQGTKLEIK

SEQ ID NO: 7722 - protein, 11 aa, synthetic construct
  REGION 1..11: note = vulinacimab light chain CDR1
QSLYYRSGYTF

SEQ ID NO: 7723 - skipped

SEQ ID NO: 7724 - protein, 9 aa, synthetic construct
  REGION 1..9: note = vulinacimab light chain CDR3
FQGTHWPYT

SEQ ID NO: 7725 - protein, 117 aa, synthetic construct
  REGION 1..117: note = xentuzumab heavy chain V region
QVELVESGGGLVQPGGSLRLSCAASGFTFTSYWMSWVRQAPGKGLELVSSITSYGSFTYYADSVKGRFTISRDNSKNTLYLQMNSLRAEDTAVYYCARNMYTHFDSWGQGTLVTVSS

SEQ ID NO: 7726 - protein, 8 aa, synthetic construct
  REGION 1..8: note = xentuzumab heavy chain CDR1
GFTFTSYW

SEQ ID NO: 7727 - protein, 8 aa, synthetic construct
  REGION 1..8: note = xentuzumab heavy chain CDR2
ITSYGSFT

SEQ ID NO: 7728 - protein, 10 aa, synthetic construct
  REGION 1..10: note = xentuzumab heavy chain CDR3
ARNMYTHFDS

SEQ ID NO: 7729 - protein, 110 aa, synthetic construct
  REGION 1..110: note = xentuzumab light chain V region
DIVLTQPPSVSGAPGQRVTISCSGSSSNIGSNSVSWYQQLPGTAPKLLIYDNSKRPSGVPDRFSGSKSGTSASLAITGLQSEDEADYYCQSRDTYGYYWVFGGGTKLTVL

SEQ ID NO: 7730 - protein, 8 aa, synthetic construct
  REGION 1..8: note = xentuzumab light chain CDR1
SSNIGSNS

SEQ ID NO: 7731 - skipped

SEQ ID NO: 7732 - protein, 11 aa, synthetic construct
  REGION 1..11: note = xentuzumab light chain CDR3
QSRDTYGYYWV

SEQ ID NO: 7733 - protein, 118 aa, synthetic construct
  REGION 1..118: note = zalifrelimab heavy chain V region
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARVGLMGPFDIWGQGTMVTVSS

SEQ ID NO: 7734 - protein, 8 aa, synthetic construct
  REGION 1..8: note = zalifrelimab heavy chain CDR1
GFTFSSYS

SEQ ID NO: 7735 - protein, 8 aa, synthetic construct
  REGION 1..8: note = zalifrelimab heavy chain CDR2
ISSSSSYI

SEQ ID NO: 7736 - protein, 11 aa, synthetic construct
  REGION 1..11: note = zalifrelimab heavy chain CDR3
ARVGLMGPFDI

SEQ ID NO: 7737 - protein, 107 aa, synthetic construct; identical to SEQ ID NO: 5533
  REGION 1..107: note = zalifrelimab light chain V region

SEQ ID NO: 7738 - protein, 6 aa, synthetic construct
  REGION 1..6: note = zalifrelimab light chain CDR1
QSVSRY

SEQ ID NO: 7739 - skipped

SEQ ID NO: 7740 - protein, 9 aa, synthetic construct
  REGION 1..9: note = zalifrelimab light chain CDR3
QQYGSSPWT

SEQ ID NO: 7741 - protein, 120 aa, synthetic construct
  REGION 1..120: note = zeluvalimab heavy chain V region
EVQLLESGGGLVQPGGSLRLSCAASGFTFSSYDMSWVRQAPGKGLEWVSLISGGGSQTYYAESVKGRFTISRDNSKNTLYLQMNSLRAEDTAVYFCASPSGHYFYAMDVWGQGTTVTVSS

SEQ ID NO: 7742 - protein, 8 aa, synthetic construct
  REGION 1..8: note = zeluvalimab heavy chain CDR1
GFTFSSYD

SEQ ID NO: 7743 - protein, 8 aa, synthetic construct
  REGION 1..8: note = zeluvalimab heavy chain CDR2
ISGGGSQT

SEQ ID NO: 7744 - protein, 13 aa, synthetic construct
  REGION 1..13: note = zeluvalimab heavy chain CDR3
ASPSGHYFYAMDV

SEQ ID NO: 7745 - protein, 107 aa, synthetic construct
  REGION 1..107: note = zeluvalimab light chain V region
DIQMTQSPSSVSASVGDRVTITCRASQGISNWLAWYQQKPGKAPKLLIFAASSLQSGVPSRFSGSGSGTDFTLTISSLQPEDFATYYCQQAESFPHTFGGGTKVEIK

SEQ ID NO: 7746 - protein, 6 aa, synthetic construct
  REGION 1..6: note = zeluvalimab light chain CDR1
QGISNW

SEQ ID NO: 7747 - skipped

SEQ ID NO: 7748 - protein, 9 aa, synthetic construct
  REGION 1..9: note = zeluvalimab light chain CDR3
QQAESFPHT

SEQ ID NO: 7749 - protein, 120 aa, synthetic construct
  REGION 1..120: note = ziltivekimab heavy chain V region
EVQLVESGGGLVQPGGSLRLSCAASGFTISSNYMIWVRQAPGKGLEWVSDLYYYAGDTYYADSVKGRFTMSRDISKNTVYLQMNSLRAEDTAVYYCARWADDHPPWIDLWGRGTLVTVSS

SEQ ID NO: 7750 - protein, 8 aa, synthetic construct
  REGION 1..8: note = ziltivekimab heavy chain CDR1
GFTISSNY

SEQ ID NO: 7751 - protein, 8 aa, synthetic construct
  REGION 1..8: note = ziltivekimab heavy chain CDR2
LYYYAGDT

SEQ ID NO: 7752 - protein, 13 aa, synthetic construct
  REGION 1..13: note = ziltivekimab heavy chain CDR3
ARWADDHPPWIDL

SEQ ID NO: 7753 - protein, 106 aa, synthetic construct
  REGION 1..106: note = ziltivekimab light chain V region
DIQMTQSPSTLSASVGDRVTITCRASQGISSWLAWYQQKPGKAPKVLIYKASTLESGVPSRFSGSGSGTEFTLTISSLQPDDFATYYCQQSWLGGSFGQGTKLEIK

SEQ ID NO: 7754 - protein, 6 aa, synthetic construct
  REGION 1..6: note = ziltivekimab light chain CDR1
QGISSW

SEQ ID NO: 7755 - skipped

SEQ ID NO: 7756 - protein, 8 aa, synthetic construct
  REGION 1..8: note = ziltivekimab light chain CDR3
QQSWLGGS

SEQ ID NO: 7757 - protein, 123 aa, synthetic construct
  REGION 1..123: note = zimberelimab heavy chain V region
QLQLQESGPGLVKPSETLTLTCTVSADSISSTTYYWVWIRQPPGKGLEWIGSISYSGSTYYNPSLKSRVTVSVDTSKNQFSLKLNSVAATDTALYYCARHLGYNGRYLPFDYWGQGTLVTVSS

SEQ ID NO: 7758 - protein, 10 aa, synthetic construct
  REGION 1..10: note = zimberelimab heavy chain CDR1
ADSISSTTYY

SEQ ID NO: 7759 - protein, 7 aa, synthetic construct
  REGION 1..7: note = zimberelimab heavy chain CDR2
ISYSGST

SEQ ID NO: 7760 - protein, 15 aa, synthetic construct
  REGION 1..15: note = zimberelimab heavy chain CDR3
ARHLGYNGRYLPFDY

SEQ ID NO: 7761 - protein, 110 aa, synthetic construct
  REGION 1..110: note = zimberelimab light chain V region
QSALTQPASVSGSPGQSITISCTGTSSDVGFYNYVSWYQQHPGKAPELMIYDVSNRPSGVSDRFSGSKSGNTASLTISGLQAEDEADYYCSSYTSISTWVFGGGTKLTVL

SEQ ID NO: 7762 - protein, 9 aa, synthetic construct
  REGION 1..9: note = zimberelimab light chain CDR1
SSDVGFYNY

SEQ ID NO: 7763 - skipped

SEQ ID NO: 7764 - protein, 10 aa, synthetic construct
  REGION 1..10: note = zimberelimab light chain CDR3
SSYTSISTWV

SEQ ID NO: 7765 - protein, 605 aa, synthetic construct; identical to SEQ ID NO: 714
  REGION 1..605: note = FMC63_VH-CH1/N84S/Q39K/S183E/CLD201-YYRR/hole/RF

SEQ ID NO: 7766 - protein, 605 aa, synthetic construct
  REGION 1..605: note = FMC63_VH-CH1/N84S/Q39K/S183E/CLD201-KYRR/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAKEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7767 - protein, 605 aa, synthetic construct
  REGION 1..605: note = FMC63_VH-CH1/N84S/Q39K/S183E/CLD201-EYRR/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAEEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7768 - protein, 605 aa, synthetic construct
  REGION 1..605: note = FMC63_VH-CH1/N84S/Q39K/S183E/CLD201-YYRK/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSKINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7769 - protein, 605 aa, synthetic construct
  REGION 1..605: note = FMC63_VH-CH1/N84S/Q39K/S183E/CLD201-KYRK/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAKEWNDNEMYLFRSSVAYAMRQYFLKVKNQMILFGEEDVRVANLKPRISFNFFVTAPKNVSDIIPRTEVEKAIRMSRSKINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7770 - protein, 605 aa, synthetic construct
  REGION 1..605: note = FMC63_VH-CH1/N84S/Q39K/S183E/CLD201-EYRK/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAEEWNDNEMYLFRSSVAYAMRQYFLKVKNQMILFGEEDVRVANLKPRISFNFFVTAPKNVSDIIPRTEVEKAIRMSRSKINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7771 - protein, 605 aa, synthetic construct
  REGION 1..605: note = FMC63_VH-CH1/N84S/Q39K/S183E/CLD201-YYRE/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSEINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7772 - protein, 605 aa, synthetic construct
  REGION 1..605: note = FMC63_VH-CH1/N84S/Q39K/S183E/CLD201-KYRE/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAKEWNDNEMYLFRSSVAYAMRQYFLKVKNQMILFGEEDVRVANLKPRISFNFFVTAPKNVSDIIPRTEVEKAIRMSRSEINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7773 - protein, 605 aa, synthetic construct
  REGION 1..605: note = FMC63_VH-CH1/N84S/Q39K/S183E/CLD201-EYRE/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAEEWNDNEMYLFRSSVAYAMRQYFLKVKNQMILFGEEDVRVANLKPRISFNFFVTAPKNVSDIIPRTEVEKAIRMSRSEINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7774 - protein, 605 aa, synthetic construct
  REGION 1..605: note = FMC63_VH-CH1/N84S/Q39K/S183E/CLD201-YKRR/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMKLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7775 - protein, 605 aa, synthetic construct
  REGION 1..605: note = FMC63_VH-CH1/N84S/Q39K/S183E/CLD201-KKRR/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAKEWNDNEMKLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7776 - protein, 605 aa, synthetic construct
  REGION 1..605: note = FMC63_VH-CH1/N84S/Q39K/S183E/CLD201-EKRR/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAEEWNDNEMKLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7777 - protein, 605 aa, synthetic construct
  REGION 1..605: note = FMC63_VH-CH1/N84S/Q39K/S183E/CLD201-YKRK/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMKLFRSSVAYAMRQYFLKVKNQMILFGEEDVRVANLKPRISFNFFVTAPKNVSDIIPRTEVEKAIRMSRSKINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7778 - protein, 605 aa, synthetic construct
  REGION 1..605: note = FMC63_VH-CH1/N84S/Q39K/S183E/CLD201-KKRK/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAKEWNDNEMKLFRSSVAYAMRQYFLKVKNQMILFGEEDVRVANLKPRISFNFFVTAPKNVSDIIPRTEVEKAIRMSRSKINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7779 - protein, 605 aa, synthetic construct
  REGION 1..605: note = FMC63_VH-CH1/N84S/Q39K/S183E/CLD201-EKRK/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAEEWNDNEMKLFRSSVAYAMRQYFLKVKNQMILFGEEDVRVANLKPRISFNFFVTAPKNVSDIIPRTEVEKAIRMSRSKINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7780 - protein, 605 aa, synthetic construct
  REGION 1..605: note = FMC63_VH-CH1/N84S/Q39K/S183E/CLD201-YKRE/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMKLFRSSVAYAMRQYFLKVKNQMILFGEEDVRVANLKPRISFNFFVTAPKNVSDIIPRTEVEKAIRMSRSEINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7781 - protein, 605 aa, synthetic construct
  REGION 1..605: note = FMC63_VH-CH1/N84S/Q39K/S183E/CLD201-KKRE/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAKEWNDNEMKLFRSSVAYAMRQYFLKVKNQMILFGEEDVRVANLKPRISFNFFVTAPKNVSDIIPRTEVEKAIRMSRSEINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7782 - protein, 605 aa, synthetic construct
  REGION 1..605: note = FMC63_VH-CH1/N84S/Q39K/S183E/CLD201-EKRE/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAEEWNDNEMKLFRSSVAYAMRQYFLKVKNQMILFGEEDVRVANLKPRISFNFFVTAPKNVSDIIPRTEVEKAIRMSRSEINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7783 - protein, 605 aa, synthetic construct
  REGION 1..605: note = FMC63_VH-CH1/N84S/Q39K/S183E/CLD201-YERR/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMELFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7784 - protein, 605 aa, synthetic construct
  REGION 1..605: note = FMC63_VH-CH1/N84S/Q39K/S183E/CLD201-KERR/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAKEWNDNEMELFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7785 - protein, 605 aa, synthetic construct
  REGION 1..605: note = FMC63_VH-CH1/N84S/Q39K/S183E/CLD201-EERR/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAEEWNDNEMELFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7786 - protein, 605 aa, synthetic construct
  REGION 1..605: note = FMC63_VH-CH1/N84S/Q39K/S183E/CLD201-YERK/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMELFRSSVAYAMRQYFLKVKNQMILFGEEDVRVANLKPRISFNFFVTAPKNVSDIIPRTEVEKAIRMSRSKINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7787 - protein, 605 aa, synthetic construct
  REGION 1..605: note = FMC63_VH-CH1/N84S/Q39K/S183E/CLD201-KERK/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAKEWNDNEMELFRSSVAYAMRQYFLKVKNQMILFGEEDVRVANLKPRISFNFFVTAPKNVSDIIPRTEVEKAIRMSRSKINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7788 - protein, 605 aa, synthetic construct
  REGION 1..605: note = FMC63_VH-CH1/N84S/Q39K/S183E/CLD201-EERK/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAEEWNDNEMELFRSSVAYAMRQYFLKVKNQMILFGEEDVRVANLKPRISFNFFVTAPKNVSDIIPRTEVEKAIRMSRSKINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7789 - protein, 605 aa, synthetic construct
  REGION 1..605: note = FMC63_VH-CH1/N84S/Q39K/S183E/CLD201-YERE/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMELFRSSVAYAMRQYFLKVKNQMILFGEEDVRVANLKPRISFNFFVTAPKNVSDIIPRTEVEKAIRMSRSEINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7790 - protein, 605 aa, synthetic construct
  REGION 1..605: note = FMC63_VH-CH1/N84S/Q39K/S183E/CLD201-KERE/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAKEWNDNEMELFRSSVAYAMRQYFLKVKNQMILFGEEDVRVANLKPRISFNFFVTAPKNVSDIIPRTEVEKAIRMSRSEINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7791 - protein, 605 aa, synthetic construct
  REGION 1..605: note = FMC63_VH-CH1/N84S/Q39K/S183E/CLD201-EERE/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAEEWNDNEMELFRSSVAYAMRQYFLKVKNQMILFGEEDVRVANLKPRISFNFFVTAPKNVSDIIPRTEVEKAIRMSRSEINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7792 - protein, 605 aa, synthetic construct
  REGION 1..605: note = FMC63_VH-CH1/N84S/Q39K/S183E/CLD201-YYKR/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMKQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7793 - protein, 605 aa, synthetic construct
  REGION 1..605: note = FMC63_VH-CH1/N84S/Q39K/S183E/CLD201-KYKR/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAKEWNDNEMYLFRSSVAYAMKQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7794 - protein, 605 aa, synthetic construct
  REGION 1..605: note = FMC63_VH-CH1/N84S/Q39K/S183E/CLD201-EYKR/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAEEWNDNEMYLFRSSVAYAMKQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7795 - protein, 605 aa, synthetic construct
  REGION 1..605: note = FMC63_VH-CH1/N84S/Q39K/S183E/CLD201-YYKK/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMKQYFLKVKNQMILFGEEDVRVANLKPRISFNFFVTAPKNVSDIIPRTEVEKAIRMSRSKINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7796 - protein, 605 aa, synthetic construct
  REGION 1..605: note = FMC63_VH-CH1/N84S/Q39K/S183E/CLD201-KYKK/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAKEWNDNEMYLFRSSVAYAMKQYFLKVKNQMILFGEEDVRVANLKPRISFNFFVTAPKNVSDIIPRTEVEKAIRMSRSKINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7797 - protein, 605 aa, synthetic construct
  REGION 1..605: note = FMC63_VH-CH1/N84S/Q39K/S183E/CLD201-EYKK/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAEEWNDNEMYLFRSSVAYAMKQYFLKVKNQMILFGEEDVRVANLKPRISFNFFVTAPKNVSDIIPRTEVEKAIRMSRSKINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7798 - protein, 605 aa, synthetic construct
  REGION 1..605: note = FMC63_VH-CH1/N84S/Q39K/S183E/CLD201-YYKE/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMKQYFLKVKNQMILFGEEDVRVANLKPRISFNFFVTAPKNVSDIIPRTEVEKAIRMSRSEINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7799 - protein, 605 aa, synthetic construct
  REGION 1..605: note = FMC63_VH-CH1/N84S/Q39K/S183E/CLD201-KYKE/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAKEWNDNEMYLFRSSVAYAMKQYFLKVKNQMILFGEEDVRVANLKPRISFNFFVTAPKNVSDIIPRTEVEKAIRMSRSEINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7800 - protein, 605 aa, synthetic construct
  REGION 1..605: note = FMC63_VH-CH1/N84S/Q39K/S183E/CLD201-EYKE/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAEEWNDNEMYLFRSSVAYAMKQYFLKVKNQMILFGEEDVRVANLKPRISFNFFVTAPKNVSDIIPRTEVEKAIRMSRSEINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7801 - protein, 605 aa, synthetic construct
  REGION 1..605: note = FMC63_VH-CH1/N84S/Q39K/S183E/CLD201-YKKR/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMKLFRSSVAYAMKQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7802 - protein, 605 aa, synthetic construct
  REGION 1..605: note = FMC63_VH-CH1/N84S/Q39K/S183E/CLD201-KKKR/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAKEWNDNEMKLFRSSVAYAMKQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7803 - protein, 605 aa, synthetic construct
  REGION 1..605: note = FMC63_VH-CH1/N84S/Q39K/S183E/CLD201-EKKR/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAEEWNDNEMKLFRSSVAYAMKQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7804 - protein, 605 aa, synthetic construct
  REGION 1..605: note = FMC63_VH-CH1/N84S/Q39K/S183E/CLD201-YKKK/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMKLFRSSVAYAMKQYFLKVKNQMILFGEEDVRVANLKPRISFNFFVTAPKNVSDIIPRTEVEKAIRMSRSKINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7805 - protein, 605 aa, synthetic construct
  REGION 1..605: note = FMC63_VH-CH1/N84S/Q39K/S183E/CLD201-KKKK/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAKEWNDNEMKLFRSSVAYAMKQYFLKVKNQMILFGEEDVRVANLKPRISFNFFVTAPKNVSDIIPRTEVEKAIRMSRSKINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7806 - protein, 605 aa, synthetic construct
  REGION 1..605: note = FMC63_VH-CH1/N84S/Q39K/S183E/CLD201-EKKK/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAEEWNDNEMKLFRSSVAYAMKQYFLKVKNQMILFGEEDVRVANLKPRISFNFFVTAPKNVSDIIPRTEVEKAIRMSRSKINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7807 - protein, 605 aa, synthetic construct
  REGION 1..605: note = FMC63_VH-CH1/N84S/Q39K/S183E/CLD201-YKKE/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMKLFRSSVAYAMKQYFLKVKNQMILFGEEDVRVANLKPRISFNFFVTAPKNVSDIIPRTEVEKAIRMSRSEINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7808 - protein, 605 aa, synthetic construct
  REGION 1..605: note = FMC63_VH-CH1/N84S/Q39K/S183E/CLD201-KKKE/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAKEWNDNEMKLFRSSVAYAMKQYFLKVKNQMILFGEEDVRVANLKPRISFNFFVTAPKNVSDIIPRTEVEKAIRMSRSEINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7809 - protein, 605 aa, synthetic construct
  REGION 1..605: note = FMC63_VH-CH1/N84S/Q39K/S183E/CLD201-EKKE/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAEEWNDNEMKLFRSSVAYAMKQYFLKVKNQMILFGEEDVRVANLKPRISFNFFVTAPKNVSDIIPRTEVEKAIRMSRSEINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7810 - protein, 605 aa, synthetic construct
  REGION 1..605: note = FMC63_VH-CH1/N84S/Q39K/S183E/CLD201-YEKR/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMELFRSSVAYAMKQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7811 - protein, 605 aa, synthetic construct
  REGION 1..605: note = FMC63_VH-CH1/N84S/Q39K/S183E/CLD201-KEKR/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAKEWNDNEMELFRSSVAYAMKQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7812 - protein, 605 aa, synthetic construct
  REGION 1..605: note = FMC63_VH-CH1/N84S/Q39K/S183E/CLD201-EEKR/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAEEWNDNEMELFRSSVAYAMKQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7813 - protein, 605 aa, synthetic construct
  REGION 1..605: note = FMC63_VH-CH1/N84S/Q39K/S183E/CLD201-YEKK/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMELFRSSVAYAMKQYFLKVKNQMILFGEEDVRVANLKPRISFNFFVTAPKNVSDIIPRTEVEKAIRMSRSKINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7814 - protein, 605 aa, synthetic construct
  REGION 1..605: note = FMC63_VH-CH1/N84S/Q39K/S183E/CLD201-KEKK/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAKEWNDNEMELFRSSVAYAMKQYFLKVKNQMILFGEEDVRVANLKPRISFNFFVTAPKNVSDIIPRTEVEKAIRMSRSKINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7815 - protein, 605 aa, synthetic construct
  REGION 1..605: note = FMC63_VH-CH1/N84S/Q39K/S183E/CLD201-EEKK/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAEEWNDNEMELFRSSVAYAMKQYFLKVKNQMILFGEEDVRVANLKPRISFNFFVTAPKNVSDIIPRTEVEKAIRMSRSKINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7816 - protein, 605 aa, synthetic construct
  REGION 1..605: note = FMC63_VH-CH1/N84S/Q39K/S183E/CLD201-YEKE/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMELFRSSVAYAMKQYFLKVKNQMILFGEEDVRVANLKPRISFNFFVTAPKNVSDIIPRTEVEKAIRMSRSEINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7817 - protein, 605 aa, synthetic construct
  REGION 1..605: note = FMC63_VH-CH1/N84S/Q39K/S183E/CLD201-KEKE/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAKEWNDNEMELFRSSVAYAMKQYFLKVKNQMILFGEEDVRVANLKPRISFNFFVTAPKNVSDIIPRTEVEKAIRMSRSEINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7818 - protein, 605 aa, synthetic construct
  REGION 1..605: note = FMC63_VH-CH1/N84S/Q39K/S183E/CLD201-EEKE/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAEEWNDNEMELFRSSVAYAMKQYFLKVKNQMILFGEEDVRVANLKPRISFNFFVTAPKNVSDIIPRTEVEKAIRMSRSEINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7819 - protein, 605 aa, synthetic construct
  REGION 1..605: note = FMC63_VH-CH1/N84S/Q39K/S183E/CLD201-YYER/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMEQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7820 - protein, 605 aa, synthetic construct
  REGION 1..605: note = FMC63_VH-CH1/N84S/Q39K/S183E/CLD201-KYER/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAKEWNDNEMYLFRSSVAYAMEQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7821 - protein, 605 aa, synthetic construct
  REGION 1..605: note = FMC63_VH-CH1/N84S/Q39K/S183E/CLD201-EYER/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAEEWNDNEMYLFRSSVAYAMEQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7822 - protein, 605 aa, synthetic construct
  REGION 1..605: note = FMC63_VH-CH1/N84S/Q39K/S183E/CLD201-YYEK/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMEQYFLKVKNQMILFGEEDVRVANLKPRISFNFFVTAPKNVSDIIPRTEVEKAIRMSRSKINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7823 - protein, 605 aa, synthetic construct
  REGION 1..605: note = FMC63_VH-CH1/N84S/Q39K/S183E/CLD201-KYEK/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAKEWNDNEMYLFRSSVAYAMEQYFLKVKNQMILFGEEDVRVANLKPRISFNFFVTAPKNVSDIIPRTEVEKAIRMSRSKINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7824 - protein, 605 aa, synthetic construct
  REGION 1..605: note = FMC63_VH-CH1/N84S/Q39K/S183E/CLD201-EYEK/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAEEWNDNEMYLFRSSVAYAMEQYFLKVKNQMILFGEEDVRVANLKPRISFNFFVTAPKNVSDIIPRTEVEKAIRMSRSKINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7825 - protein, 605 aa, synthetic construct
  REGION 1..605: note = FMC63_VH-CH1/N84S/Q39K/S183E/CLD201-YYEE/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMEQYFLKVKNQMILFGEEDVRVANLKPRISFNFFVTAPKNVSDIIPRTEVEKAIRMSRSEINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7826 - protein, 605 aa, synthetic construct
  REGION 1..605: note = FMC63_VH-CH1/N84S/Q39K/S183E/CLD201-KYEE/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAKEWNDNEMYLFRSSVAYAMEQYFLKVKNQMILFGEEDVRVANLKPRISFNFFVTAPKNVSDIIPRTEVEKAIRMSRSEINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7827 - protein, 605 aa, synthetic construct
  REGION 1..605: note = FMC63_VH-CH1/N84S/Q39K/S183E/CLD201-EYEE/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAEEWNDNEMYLFRSSVAYAMEQYFLKVKNQMILFGEEDVRVANLKPRISFNFFVTAPKNVSDIIPRTEVEKAIRMSRSEINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7828 - protein, 605 aa, synthetic construct
  REGION 1..605: note = FMC63_VH-CH1/N84S/Q39K/S183E/CLD201-YKER/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMKLFRSSVAYAMEQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7829 - protein, 605 aa, synthetic construct
  REGION 1..605: note = FMC63_VH-CH1/N84S/Q39K/S183E/CLD201-KKER/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAKEWNDNEMKLFRSSVAYAMEQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7830 - protein, 605 aa, synthetic construct
  REGION 1..605: note = FMC63_VH-CH1/N84S/Q39K/S183E/CLD201-EKER/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAEEWNDNEMKLFRSSVAYAMEQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7831 - protein, 605 aa, synthetic construct
  REGION 1..605: note = FMC63_VH-CH1/N84S/Q39K/S183E/CLD201-YKEK/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMKLFRSSVAYAMEQYFLKVKNQMILFGEEDVRVANLKPRISFNFFVTAPKNVSDIIPRTEVEKAIRMSRSKINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7832 - protein, 605 aa, synthetic construct
  REGION 1..605: note = FMC63_VH-CH1/N84S/Q39K/S183E/CLD201-KKEK/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAKEWNDNEMKLFRSSVAYAMEQYFLKVKNQMILFGEEDVRVANLKPRISFNFFVTAPKNVSDIIPRTEVEKAIRMSRSKINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7833 - protein, 605 aa, synthetic construct
  REGION 1..605: note = FMC63_VH-CH1/N84S/Q39K/S183E/CLD201-EKEK/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAEEWNDNEMKLFRSSVAYAMEQYFLKVKNQMILFGEEDVRVANLKPRISFNFFVTAPKNVSDIIPRTEVEKAIRMSRSKINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7834 - protein, 605 aa, synthetic construct
  REGION 1..605: note = FMC63_VH-CH1/N84S/Q39K/S183E/CLD201-YKEE/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMKLFRSSVAYAMEQYFLKVKNQMILFGEEDVRVANLKPRISFNFFVTAPKNVSDIIPRTEVEKAIRMSRSEINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7835 - protein, 605 aa, synthetic construct
  REGION 1..605: note = FMC63_VH-CH1/N84S/Q39K/S183E/CLD201-KKEE/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAKEWNDNEMKLFRSSVAYAMEQYFLKVKNQMILFGEEDVRVANLKPRISFNFFVTAPKNVSDIIPRTEVEKAIRMSRSEINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7836 - protein, 605 aa, synthetic construct
  REGION 1..605: note = FMC63_VH-CH1/N84S/Q39K/S183E/CLD201-EKEE/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAEEWNDNEMKLFRSSVAYAMEQYFLKVKNQMILFGEEDVRVANLKPRISFNFFVTAPKNVSDIIPRTEVEKAIRMSRSEINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7837 - protein, 605 aa, synthetic construct
  REGION 1..605: note = FMC63_VH-CH1/N84S/Q39K/S183E/CLD201-YEER/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMELFRSSVAYAMEQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7838 - protein, 605 aa, synthetic construct
  REGION 1..605: note = FMC63_VH-CH1/N84S/Q39K/S183E/CLD201-KEER/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAKEWNDNEMELFRSSVAYAMEQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7839 - protein, 605 aa, synthetic construct
  REGION 1..605: note = FMC63_VH-CH1/N84S/Q39K/S183E/CLD201-EEER/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAEEWNDNEMELFRSSVAYAMEQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7840 - protein, 605 aa, synthetic construct
  REGION 1..605: note = FMC63_VH-CH1/N84S/Q39K/S183E/CLD201-YEEK/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMELFRSSVAYAMEQYFLKVKNQMILFGEEDVRVANLKPRISFNFFVTAPKNVSDIIPRTEVEKAIRMSRSKINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7841 - protein, 605 aa, synthetic construct
  REGION 1..605: note = FMC63_VH-CH1/N84S/Q39K/S183E/CLD201-KEEK/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAKEWNDNEMELFRSSVAYAMEQYFLKVKNQMILFGEEDVRVANLKPRISFNFFVTAPKNVSDIIPRTEVEKAIRMSRSKINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7842 - protein, 605 aa, synthetic construct
  REGION 1..605: note = FMC63_VH-CH1/N84S/Q39K/S183E/CLD201-EEEK/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAEEWNDNEMELFRSSVAYAMEQYFLKVKNQMILFGEEDVRVANLKPRISFNFFVTAPKNVSDIIPRTEVEKAIRMSRSKINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7843 - protein, 605 aa, synthetic construct
  REGION 1..605: note = FMC63_VH-CH1/N84S/Q39K/S183E/CLD201-YEEE/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMELFRSSVAYAMEQYFLKVKNQMILFGEEDVRVANLKPRISFNFFVTAPKNVSDIIPRTEVEKAIRMSRSEINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7844 - protein, 605 aa, synthetic construct
  REGION 1..605: note = FMC63_VH-CH1/N84S/Q39K/S183E/CLD201-KEEE/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAKEWNDNEMELFRSSVAYAMEQYFLKVKNQMILFGEEDVRVANLKPRISFNFFVTAPKNVSDIIPRTEVEKAIRMSRSEINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7845 - protein, 605 aa, synthetic construct
  REGION 1..605: note = FMC63_VH-CH1/N84S/Q39K/S183E/CLD201-EEEE/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAEEWNDNEMELFRSSVAYAMEQYFLKVKNQMILFGEEDVRVANLKPRISFNFFVTAPKNVSDIIPRTEVEKAIRMSRSEINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 7846 - protein, 214 aa, synthetic construct; identical to SEQ ID NO: 740
  REGION 1..214: note = FMC63_VK-CK/Q38E/V133K

SEQ ID NO: 7847 - protein, 244 aa, synthetic construct
  REGION 1..244: note = Fc6/knob
MLLLARCLLLVLVSSLLVCSGLACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 7848 - protein, 227 aa, synthetic construct
  source 1..227: note = Polypeptide with internal non-peptidyl moiety (part 2 of 2). TNR1B-alkyne-azide-Fc6
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7849 - protein, 227 aa, synthetic construct; identical to SEQ ID NO: 7848
  source 1..227: note = Polypeptide with internal non-peptidyl moiety (part 2 of 2). TNR1B-alkyne-azide-PEG4-Fc6
